US009487571B2

(12) United States Patent
DiMarchi et al.

(10) Patent No.: US 9,487,571 B2
(45) Date of Patent: Nov. 8, 2016

(54) GLUCAGON ANTAGONIST-GIP AGONIST CONJUGATES AND COMPOSITIONS FOR THE TREATMENT OF METABOLIC DISORDERS AND OBESITY

(71) Applicant: Indiana University Research and Technology Corporation, Indianapolis, IN (US)

(72) Inventors: Richard D. DiMarchi, Carmel, IN (US); Tao Ma, Bloomington, IN (US)

(73) Assignee: Indiana University Research and Technology Corporation, Indianapolis, IN (US)

(*) Notice: Subject to any disclaimer, the term of this patent is extended or adjusted under 35 U.S.C. 154(b) by 198 days.

(21) Appl. No.: 14/026,671

(22) Filed: Sep. 13, 2013

(65) Prior Publication Data

US 2014/0107021 A1   Apr. 17, 2014

Related U.S. Application Data

(63) Continuation of application No. 13/575,363, filed as application No. PCT/US2011/022608 on Jan. 26, 2011, now Pat. No. 8,551,946.

(60) Provisional application No. 61/298,812, filed on Jan. 27, 2010.

(51) Int. Cl.
*A61K 38/26* (2006.01)
*A61K 38/00* (2006.01)
*C07K 14/605* (2006.01)

(52) U.S. Cl.
CPC .......... *C07K 14/605* (2013.01); *A61K 38/26* (2013.01)

(58) Field of Classification Search
None
See application file for complete search history.

(56) References Cited

U.S. PATENT DOCUMENTS

| | | | |
|---|---|---|---|
| 4,275,152 A | 6/1981 | Esders et al. |
| 5,359,030 A | 10/1994 | Ekwuribe |
| 5,510,459 A | 4/1996 | Smith et al. |
| 5,512,549 A | 4/1996 | Chen et al. |
| 5,545,618 A | 8/1996 | Buckley et al. |
| 5,665,705 A | 9/1997 | Merrifield et al. |
| 5,783,674 A | 7/1998 | Geysin et al. |
| 6,191,102 B1 | 2/2001 | DiMarchi et al. |
| 6,329,336 B1 | 12/2001 | Bridon et al. |
| 6,583,111 B1 | 6/2003 | DiMarchi et al. |
| 6,677,136 B2 | 1/2004 | Marshall et al. |
| 7,192,922 B2 | 3/2007 | Shannon et al. |
| 7,211,557 B2 | 5/2007 | DiMarchi et al. |
| 7,326,688 B2 | 2/2008 | O'Harte et al. |
| 7,557,183 B2 | 7/2009 | DiMarchi et al. |
| 7,576,059 B2 | 8/2009 | Jonassen et al. |
| 8,053,560 B2 | 11/2011 | Sheffer et al. |

| | | |
|---|---|---|
| 2002/0049164 A1 | 4/2002 | Demuth et al. |
| 2003/0021795 A1 | 1/2003 | Houston et al. |
| 2003/0143183 A1 | 7/2003 | Knudsen et al. |
| 2003/0195157 A1 | 10/2003 | Natarajan et al. |
| 2003/0204063 A1 | 10/2003 | Gravel et al. |
| 2004/0002468 A1 | 1/2004 | Wadsworth et al. |
| 2004/0235710 A1 | 11/2004 | DeFilippis et al. |
| 2005/0070469 A1 | 3/2005 | Bloom et al. |
| 2005/0095679 A1 | 5/2005 | Prescott et al. |
| 2005/0124550 A1 | 6/2005 | Peri |
| 2005/0153890 A1 | 7/2005 | Pan et al. |
| 2005/0288248 A1 | 12/2005 | Pan et al. |
| 2006/0003417 A1 | 1/2006 | Pan et al. |
| 2006/0003935 A1 | 1/2006 | Pan et al. |
| 2006/0084604 A1 | 4/2006 | Kitaura et al. |
| 2006/0171920 A1 | 8/2006 | Shechter et al. |
| 2006/0210534 A1 | 9/2006 | Lee et al. |
| 2006/0252916 A1 | 11/2006 | DiMarchi et al. |
| 2006/0286129 A1 | 12/2006 | Sarubbi |
| 2007/0042956 A1 | 2/2007 | Johansen et al. |
| 2007/0173452 A1 | 7/2007 | DiMarchi et al. |
| 2007/0203058 A1 | 8/2007 | Lau et al. |
| 2007/0287670 A1 | 12/2007 | Natarajan et al. |

(Continued)

FOREIGN PATENT DOCUMENTS

| | | |
|---|---|---|
| CA | 2024855 | 3/1992 |
| EP | 0220958 | 5/1987 |
| EP | 0479210 | 4/1992 |
| EP | 0708179 | 4/1996 |
| EP | 0815135 | 9/1996 |

(Continued)

OTHER PUBLICATIONS

"Peptides: Frontiers of Peptide Science," Proceedings of the Fifteenth American Peptide Symposium, Jun. 14-19, 1997, Nashville, Tennessee, USA; ed. James P. Tam and Praven T.P. Kaumaya.

(Continued)

*Primary Examiner* — Shulamith H Shafer
(74) *Attorney, Agent, or Firm* — Barnes & Thornburg LLP

(57) ABSTRACT

Provided herein are peptide combinations comprising a GIP agonist peptide and a glucagon antagonist peptide. In some embodiments, the peptide combination is provided as a composition, e.g., a pharmaceutical composition, while in other embodiments, the peptide combination is provided as a kit. In yet other embodiments, the peptide combination is provided as a conjugate, e.g., a fusion peptide, a heterodimer. In specific aspects, the GIP agonist peptide is an analog of native human glucagon. In specific aspects, the glucagon antagonist peptide is an analog of native human glucagon. In some embodiments, the GIP agonist peptide is covalently attached to the glucagon antagonist peptide via a linker. Method of treating a disease, e.g., a metabolic disorder, such as diabetes and obesity, comprising administering the peptide compositions described herein are further provided.

10 Claims, 41 Drawing Sheets

(56) References Cited

U.S. PATENT DOCUMENTS

| | | |
|---|---|---|
| 2008/0113905 A1 | 5/2008 | DiMarchi et al. |
| 2008/0125574 A1 | 5/2008 | Sheffer et al. |
| 2008/0312157 A1 | 12/2008 | Levy et al. |
| 2008/0318837 A1 | 12/2008 | Quay et al. |
| 2009/0036364 A1 | 2/2009 | Levy et al. |
| 2009/0054305 A1 | 2/2009 | Schlein et al. |
| 2009/0062192 A1 | 3/2009 | Christensen et al. |
| 2009/0074769 A1 | 3/2009 | Glaesner et al. |
| 2009/0137456 A1 | 5/2009 | DiMarchi et al. |
| 2009/0186817 A1 | 7/2009 | Ghosh et al. |
| 2009/0192072 A1 | 7/2009 | Pillutla et al. |
| 2010/0190699 A1 | 7/2010 | DiMarchi et al. |
| 2010/0190701 A1 | 7/2010 | Day et al. |
| 2010/0204105 A1 | 8/2010 | Riber et al. |
| 2011/0065633 A1 | 3/2011 | DiMarchi et al. |
| 2011/0098217 A1 | 4/2011 | DiMarchi et al. |
| 2011/0166062 A1 | 7/2011 | DiMarchi et al. |
| 2011/0190200 A1 | 8/2011 | DiMarchi et al. |
| 2011/0257092 A1 | 10/2011 | DiMarchi et al. |
| 2011/0288003 A1 | 11/2011 | DiMarchi et al. |

FOREIGN PATENT DOCUMENTS

| | | |
|---|---|---|
| EP | 1695983 B1 | 8/2006 |
| EP | 2036539 A1 | 3/2009 |
| EP | 2036923 A1 | 3/2009 |
| EP | 2398483 | 8/2010 |
| EP | 2300035 | 1/2012 |
| JP | 2003/192698 | 7/2003 |
| WO | WO91/11457 | 8/1991 |
| WO | WO96/29342 | 9/1996 |
| WO | WO 9707814 | 3/1997 |
| WO | 97/29180 | 8/1997 |
| WO | WO97046584 | 12/1997 |
| WO | 98/11126 | 3/1998 |
| WO | 98/19698 | 5/1998 |
| WO | WO 9824464 | 6/1998 |
| WO | WO 9946283 | 9/1999 |
| WO | WO99/67278 | 12/1999 |
| WO | WO 0020592 | 4/2000 |
| WO | 00/34331 | 6/2000 |
| WO | WO00/42026 | 7/2000 |
| WO | WO 0058360 | 10/2000 |
| WO | 01/83527 | 11/2001 |
| WO | WO 0181919 | 11/2001 |
| WO | 01/98331 | 12/2001 |
| WO | WO 0210195 | 2/2002 |
| WO | WO0213801 | 2/2002 |
| WO | 02/48183 | 6/2002 |
| WO | WO 02100390 | 12/2002 |
| WO | WO03/011892 | 2/2003 |
| WO | 03/020201 | 3/2003 |
| WO | WO03022304 | 3/2003 |
| WO | WO 03026635 | 4/2003 |
| WO | 03/035099 | 5/2003 |
| WO | WO03/058203 | 7/2003 |
| WO | WO 03082898 | 10/2003 |
| WO | 03/103572 | 12/2003 |
| WO | WO 03103697 | 12/2003 |
| WO | WO 03105760 | 12/2003 |
| WO | WO2004000354 | 12/2003 |
| WO | 2004/022004 | 3/2004 |
| WO | 2004/067548 | 8/2004 |
| WO | WO 2004078777 | 9/2004 |
| WO | 2004/093823 | 11/2004 |
| WO | 2004/105781 | 12/2004 |
| WO | 2004/105790 | 12/2004 |
| WO | WO 2004103390 | 12/2004 |
| WO | WO 2005082928 | 9/2005 |
| WO | WO 2006086769 | 8/2006 |
| WO | WO 2006121904 | 11/2006 |
| WO | WO2006124529 | 11/2006 |
| WO | WO2006134340 A2 | 12/2006 |
| WO | WO2007/124461 | 1/2007 |
| WO | 2007/022123 | 2/2007 |
| WO | WO 2007028632 | 3/2007 |
| WO | WO2007028633 | 3/2007 |
| WO | 2007/056362 | 5/2007 |
| WO | 2007/100535 | 9/2007 |
| WO | WO 2007109354 | 9/2007 |
| WO | WO 2008021560 | 2/2008 |
| WO | WO 2008022015 | 2/2008 |
| WO | WO2008023050 | 2/2008 |
| WO | WO 2008076933 | 6/2008 |
| WO | 2008/086086 | 7/2008 |
| WO | 2008/101017 | 8/2008 |
| WO | WO2009030738 A1 | 3/2009 |
| WO | WO2009030774 A1 | 3/2009 |
| WO | WO2009034117 A1 | 3/2009 |
| WO | WO2009034118 A1 | 3/2009 |
| WO | WO2009034119 A1 | 3/2009 |
| WO | WO2009035540 A2 | 3/2009 |
| WO | 2009/058662 | 5/2009 |
| WO | 2009/058734 | 5/2009 |
| WO | 2009/059278 | 5/2009 |
| WO | 2009/095479 | 8/2009 |
| WO | 2009/099763 | 8/2009 |
| WO | 2009/155257 | 12/2009 |
| WO | 2009/155258 | 12/2009 |
| WO | 2010/011439 | 1/2010 |
| WO | 2010/071807 | 6/2010 |
| WO | 2010/080605 | 7/2010 |
| WO | 2010/096052 | 8/2010 |
| WO | 2010/148089 | 12/2010 |
| WO | 2011/075393 | 6/2011 |
| WO | WO 2011087671 | 7/2011 |
| WO | WO 2011087672 | 7/2011 |
| WO | 2011/094337 | 8/2011 |
| WO | WO2011119657 | 9/2011 |
| WO | WO2011143208 | 11/2011 |
| WO | WO2011143209 | 11/2011 |
| WO | WO2011163012 | 12/2011 |
| WO | WO2011163473 | 12/2011 |

OTHER PUBLICATIONS

Ahn, J.M. et al., A new approach to search for the bioactive conformation of glucagon: positional cyclization scanning, *J. Med. Chem.*, 44(19): 3109-16, Sep. 13, 2001.

Ahn, J.M. et al., Development of potent truncated glucagon antagonists, *J. Med. Chem.*, 44(9): 1372-9, Apr. 26, 2001. (Abstract).

Chabenne et al., Optimization of the native glucagon sequence for medicinal purposes, J. Diabetes. Sci. Technol., 4(6): 1322-31, Nov. 1, 2010.

Day et al., Charge inversion at position 68 of the glucagon and glucagon-like peptide-1 receptors supports selectivity in hormone action. *J. Pept. Sci.*, 17(3): 218-25, Nov. 30, 2010.

De et al., Synthesis and characterization of ester-based prodrugs of glucagon-like peptide 1, *Biopolymers*, 94(4): 448-56 (2010).

De, Design of peptide-based prodrug chemistry and its application to glucagon-like peptide 1. Masters Thesis Aug. 2007. [Retrieved from the Internet on Jun. 16, 2009: <https://scholarworksiu.edu/dspace/browse?value=De%2C+ArnabBtype=author>]; p. 8, para 2; p. 16, para 3; p. 40, para 1; p. 66, para 2; p. 77, para 1-2; p. 79, para 1.

Gelfanov, et al. , Discover and Structural Optimization of High Affinity Co-Agonists at the Glucagon and GLP-1 Receptors, Understanding Biology Using Peptides, Springer, pp. 763-764, Jun. 23, 2005.

GenBank entry AAH05278. Jul. 15, 2006. [Retrieved from the Internet Jun. 18, 2009: ~http://www._ncbi._nim.n ih.gov/protein/13528972>].

Habegger et al., The metabolic actions of glucagon revisited, *Nat. Rev. Endocrinol.*, 6(12): 689-97, Oct. 19, 2010.

Harris, J. Milton, Final Word: PEGylation—A "Sunset" Technology? <http://licence.icopyright.net/user/viewFreeUse.act?fuid=OTU1NjY3OA%3D%3D>, BioPharm International, Jun. 1, 2004.

Heppner et al., Glucagon regulation of energy metabolism, *Physiol Behav.*, 100(5): 545-8, Apr. 8, 2010.

(56) References Cited

OTHER PUBLICATIONS

Hruby et al., "The Design and Biological Activities of Glucagon Agonists and Antagonists, and Their Use in Examining the Mechanisms of Glucose Action," Curr. Med. Chem.-Imm., Endoc. & Metab. Agents, 2001, 1, pp. 199-215.
Jonathan Day et al., "A New Glucagon and GLP-1 Co-Agonist Eliminates Obesity in Rodents," Nature Chemical Biology, vol. 5, No. 10, Oct. 2009, pp. 749-757.
Joshi et al, "Studies on the Mechanism of Aspartic Acid Cleavage and Glutamine Deamidation in the Acidic Degradation of Glucagon," Journal of Pharmaceutical Sciences, vol. 94, No. 9, Sep. 2005, pp. 1912-1927.
Joshi et al., "The Degradation Pathways of Glucagon in Acidic Solutions," International Journal of Pharmaceutics, 203 (2000), pp. 115-125.
Joshi et al., "The Estimation of Glutaminyl Deamidation and Aspartyl Cleavage Rates in Glucagon," International Journal of Pharmaceutics, 273 (2004), pp. 213-219.
Krstenansky et al., "Importance of the C-terminal α-helical structure for glucagon's biological activity," Int. J. Peptide Protein Res., 32, 1988, 468-475.
Lee et al., "Synthesis, Characterization, and Pharmacokinetic Studies of PEGylated Glucagon-like Peptide-1," Bioconjugate Chem., 2005, vol. 16, No. 2, pp. 377-382.
Levy et al., Optimization of the C-terminal Sequence in Glucagon to Maximize Receptor Affinity, Poster Presentation, Jun. 19, 2005.
Levy et al., Optimization of the C-terminal Sequence in Glucagon to Maximize Receptor Affinity, Understanding Biology Using Peptides, American Peptide Society, Apr. 2006.
Li et al., Crystallization and preliminary X-ray analysis of anti-obesity peptide hormone oxyntomodulin, Protein & Peptide Letters, 15(2): 232-4 (2008).
Li et al., Design, synthesis and crystallization of a novel glucagon analog as a therapeutic agent, Acta Crystallogr. Sect. F Struct. Biol. Cryst. Commun., 63(Pt 7):599-601, Jun. 15, 2007.
Li et al., Structural Basis for Enhanced Solublity of a C-Terminally Extended Glucagon Analog , Biopolymers., 96(4): 480 (2011).
M.J. Roberts et al., "Chemistry for Peptide and Protein PEGylation," Advance Drug Delivery Reviews, Elsevier BV, Amsterdam, NL, vol. 54, No. 4, Jun. 17, 2002, pp. 459-476.
Marita P. Feldkaemper et al., "Localization and Regulation of Glucagon Receptors in the Chick Eye and Preproglucagon and Glucagon Receptor Expression in the Mouse Eye," Experimental Eye Research, Academic Press Ltd., London, vol. 79, No. 3, Sep. 1, 2004, pp. 321-329.
McKee et al., Receptor Binding and Adenylate Cyclase Activities of Glucagon Analogues Modified in the N-Terminal Region, Biochemistry, 25: 1650-6 (1986).
Nogueiras et al., Direct control of peripheral lipid deposition by CNS GLP-1 receptor signaling is mediated by the sympathetic nervous system and blunted in diet-induced obesity, J. Neurosci., 29(18): 5916-25, May 6, 2009.
Ouyang et al., Discovery of Bi-Functional Peptides Balanced in Glucagon Antagonism & GLP-1 Agonism. A Search for the Molecular Basis in the Inversion of Activity at Homologous Receptors, 71st Scientific sessions of American Diabetes Association 2011—Post-Conference Review and Analysis.
Pan et al., Design of a Long Acting Peptide Functioning as Both a Glucagon-like Peptide-1 Receptor Agonist and a Glucagon Receptor Agonist, J. Biol. Chem., 281(18): 12506-15, Table 1, May 5, 2006.
Patterson et al., A novel human-based receptor antagonist of sustained action reveals body weight control by endogenous GLP-1, ACS Chem Biol., 6(2): 135-45 Nov. 4, 2010.
Patterson et al., Functional association of the N-terminal residues with the central region in glucagon-related peptides, J. Peptide Sci., First published online Jun. 10, 2011.
PCT International Search Report for PCT/US2008/050099 completed by the US Searching Authority on Sep. 1, 2008.
PCT International Search Report for PCT/US2008/053857 completed by the US Searching Authority on Sep. 16, 2008.
PCT International Search Report for PCT/US2008/080973 completed by the US Searching Authority on Jun. 6, 2009.
PCT International Search Report for PCT/US2008/081333 completed by the US Searching Authority on Mar. 12, 2009.
PCT International Search Report for PCT/US2009/031593 completed by the US Searching Authority on Jun. 18, 2009.
Robberecht, P. et al., "Receptor Occupancy and Adenylate Cyclase Activation in Rat Liver and Heart Membranes by 10 Glucagon Analogs Modified in Position 2, 3, 4, 25, 27 and/or 29," Regulatory Peptides, 21 (1988), 117-128.
Sapse et al., The Role of Sale Bridge Formation in Glucagon: An Experimental and Theoretical Study of Glucagon Analogs and Peptide Fragments of Glucagon, Molec. Med., 8(5): 251-62, May 1, 2002.
Stigsnaes et al., "Characterisation and Physical Stability of PEGylated Glucagon," International Journal of Pharmaceutics, 330 (2007), pp. 87-98.
Traylor et al., Identification of the High Potency Glucagon Agonist with Enhanced Biophysical Stability and Aqueous Solubility, Poster Abstract PY 10, pp. 505-506, Jun. 10, 2005.
Trivedi, D. et al., Design and synthesis of conformationally constrained glucagon analogues, J. Med. Chem., 43(9): 1714-22, May 4, 2000 (Abstract).
Tschoep et al., A Novel Glucagon/GLP-1 Co-Agonist Eliminated Obesity in Rodents, Diabetes, 58 (Supp. 1): A83 (2009).
Unson et al., "Glucagon antagonists: Contribution to binding and activity of the amino-terminal sequence 1-5, position 12 and the putative alpha-helical segment 19-27," J. Biol. Chem. v264, pp. 789-794, Jan. 15, 1989, p. 792, para 1, Table 1.
Unson et al., Positively Charged Residues at Positions 12, 17, and 18 of Glucagon Ensure Maximum Biological Potency, J. Biol. Chem., 273(17): 10308-12 (1998).
Ward et al., In vitro and in vivo evaluation of native glucagon and glucagon analog (MAR-D28) during aging: lack of cytotoxicity and preservation of hyperglycemic effect, J. Diabetes Sci. Technol., 4(6):1311-21, Nov. 1, 2010.
Wynne et al., "Subcutaneous Oxyntomodulin Reduces Body Weight in Overweight and Obese Subjects,"Diabetes, vol. 54, Aug. 2005, pp. 2390-2395.
Yang et al., Synthesis and Biological Assessment of Sulfonic Acid-Based Glucagon Antagonists, Understanding Biology Using Peptides, American Peptide Symposia, 9(Part 6): 305-6 (2006).
Zhang et al., Design and synthesis of novel GLP1 analogues with significantly prolonged time action, Biopolymers., 80(4): 555 (2005).
Azizeh et al., "Topographical amino acid substitution in position 10 of glucagon leads to antagonists/partial agonists with greater binding differences," J. Med. Chem., vol. 39, No. 13, Jun. 21, 1996, pp. 2449-2455.
Azizeh et al., "Pure glucagon antagonists: biological activities and cAMP accumulation using phosphodiesterase inhibitors," Peptides 1997, vol. 18, No. 5, pp. 663-641.
Madsen et al., "Structure—Activity and Protraction Relationship of Long-Acting Glucagon-like Peptide-1 Derivatives: Importance of Fatty acid Length, Polarity, and Bulkiness," J. Med. Chem. 2007, 50, pp. 6126-6132.
Phillips et al., "Supramolecular Protein Engineering: Design of Zinc-Stapled Insulin Hexamers As A Long Acting Depot," J. Biol. Chem., vol. 285, No. 16, Apr. 16, 2010, pp. 11755-11759.
Murphy, et al., "Potent Long-Acting Alkylated Analogs of Growth Hormone-Releasing Factor," Pept. Res., vol. 1, No. 1, pp. 36-41 (1988).
De, et al., "Investigation of the feasibily of an amide-based prodrug under physiological conditions," Int. J. Pept. Res. Ther., 14, pp. 255-262 (2008).
PCT International Search Report for PCT/US2011/041601 completed by the US Searching Authority on Nov. 10, 2011.

(56) References Cited

OTHER PUBLICATIONS

Perret et al., "Mutational analysis of the glucagon receptor: similarities with the vasoactive intestinal peptide (VIP)/pituitary adenylate cyclase-activating peptide (PACAP)/secretin receptors for recognition of the ligand's third residue," J. Biochem., 362 (2002), pp. 389-394.
Gysin et al., "Design and Synthesis of Glucagon Partial Agonists and Antagonists," Biochemistry, 25, (1986), pp. 8278-8284.
PCT International Search Report for PCT/US2009/047437 completed by the US Searching Authority on Nov. 3, 2009.
Supplemental European Search Report issued in connection with EP Application No. 09767567.2 issued on Jun. 17, 2011.
Extended EP Search Report completed by the EP Searching Authority on Apr. 6, 2011 in connection with EP Patent Application No. 08845852.6.
DatabaseEMBL, Jul. 16, 2007, Richard DiMarchi and David Smiley, "Human Glucagon Peptide SEQ ID No. 1," XP002631582, retrieved from EBI, Database Accession No. AGB07042, Abstract.
Day et al., "A new glucagon and GLP-1 co-agonist eliminates obesity in rodents", Nature Chemical Biology (2009), 5(10), 749-757.
Day, J.; Patterson, J.; Gelfanov, V. and DiMarchi, Richard Molecular-basis for Specificity in Biological Action at the Homologous Glucagon and GLP-1 Receptors, (2009) Proceedings of the 21st American Peptide Society 142-143.
De, A. and DiMarchi, R. Synthesis & Analysis of Peptide Hormone-based prodrugs, (2009) Proceedings of the 21st American Peptide Society 160-161.
De, Arnab; DiMarchi, Richard D. Investigation of the feasibility of an amide-based prodrug under physiological conditions. International Journal of Peptide Research and Therapeutics (2008), 14(4), 393.
De, A. and DiMarchi, R. Synthesis & Characterization of Ester-Based Prodrugs of Glucagon-Like Peptide 1, Peptide Science (2010) 94(4) 448-456.
DiMarchi, Richard, "The Use of Bioproducts in the Treatments of Metabolic Diseases" presentation slides for the Keystone Symposia (Jan. 25, 2009, Banff, Alberta).
Finan, B.; Gelfanov, V. and DiMarchi, R. Assessment of a Tat-Derived Peptide as a Vector for Hormonal Transport, (2009) Proceedings of the 21st American Peptide Society 321-322.
Kukuch, A.; Patterson, J.; DiMarchi, R. and Tolbert, T Immunoglobulin Fc-based Peptide Fusion Proteins as a Basis for Optimizing In Vivo Pharmacology, (2009) Proceedings of the 21st American Peptide Society 177-178.
Ma, T.; Day, J.; Gelfanov, V. and DiMarchi, R. Discovery and Structural Optimization of High Affinity Co-Agonists at the Glucagon and GLP-1 Receptors, (2009) Proceedings of the 21st American Peptide Society 146-147.
Ouyang et al., "Synthesis and Characterization of Peptides with Glucagon Antagonism and GLP-1 Agonism," poster presentation at the 21st American Peptide Symposium (Jun. 7-12, 2009, Bloomington, IN).
Tschoep et al., "A Novel Glucagon/GLP-1 Co-Agonist Eliminates Obesity in Rodents," American Diabetes Association Abstract No. 313-OR (2009).
Tschoep, Matthias, "A Novel Glucagon/GLP-1 Co-Agonist Eliminates Obesity in Rodents" presentation slides for the 2009 American Diabetes Association meeting (Jun. 5-9, 2009, New Orleans, LA).
Tschoep, Matthias, "Afferent Gut Hormones in the Control of Energy Balance and Metabolism" presentation slides for the 21st American Peptide Symposium (Jun. 7-12, 2009, Bloomington, IN).
Ward, B.; Finan, B.; Gelfanov, V. and DiMarchi, R. Exploring the N-terminal Hydrophobic Faces of Glucagon and Glucagon-like Peptide-1, (2009) Proceedings of the 21st American Peptide Society 153-154.
Yang, B. and DiMarchi, R.D. (2005). A Novel Approach to Resin-based Cysteine Alkylation Peptides: Chemistry, Structure and Biology, Proceedings of the XIX American Peptide Symposium, (88-89).
Irwin et al., "Early administration of the glucose-dependent insulinotropic polypeptide receptor antagonist (Pro$^3$) GIP prevents the development of diabetes and related metabolic abnormalities associated with genetically inherited obesity in ob/ob mice," Diabetologia 50:1532-1540 (2007).
Kulkarni, "GIP: No Longer the Neglected Incretin Twin?," Science Translational Medicine 2(49): p. 47, Sep. 15, 2010.
Montrose-Rafizadeh et al., "High Potency Antagonists of the Pancreatic Glucagon-like Peptide-1 Receptor," Journal of Biological Chemistry, 272(34) 21201-21206 (1997).
Sturm et al., "Structure-Function Studies on Positions 17, 18, and 21 Replacement Analogues of Glucagon: The Importance of Charged Residues and Salt Bridges in Glucagon Biological Activity," J Med Chem 1998, 41, 2693-2700.
Habi, "Special Issue: Program and Abstracts for the 19th American Peptide Symposium, 2005, Abstracts of Poster Section C," (pp. 574-603) Article first published online. Jun. 10, 2005 | DOI: 10.1002/bip.20325.
Blache et al., "Development of an oxyntomodulin/glicentin C-terminal radioimmunoassay using a "thiol-maleoyl" coupling method for preparing the immunogen," Anal Biochem 1988 173(1):151-159 (1988), abstract only.
Vijayalakshmi et al., "Comparison of Helix-Stabilizing Effects of α, α-dialkyl Glycines with Linear and Cycloalkyl Side Chains", Biopolymers 53: 84-98 (Jan. 21, 2000).
Andrews et al., "Forming Stable Helical Peptides Using Natural and Artificial Amino Acids", Tetrahedron 55: 11711-11743, (1999).
Battersby et al., "Diketopiperazine Formation and N-Terminal Degradation in Recombinant Human Growth Hormone", International Journal of Peptide & Protein Research 44: 215-222, (1994).
Eriksson et al., "hPEPT1 Affinity and Translocation of Selected Gln-Sar and Glu-Sar Dipeptide Derivatives", Molecular Pharmaceutics vol. 2, No. 3: 242-249 (May 10, 2005).
Garcia-Aparicio et al., "Design and Discovery of a Novel Dipeptidyl-peptidase IV (CD26)-Based Prodrug Approach", J. Med. Chem. 49: 5339-5351 (2006).
Goolcharran et al., "Comparison of the Rates of Deamidation, Diketopiperazine Formation, and Oxidation in Recombinant Human Vascular Endothelial Growth Factor and Model Peptides", AAPS Pharmsci 2000 2(1) article 5: 1-6 (Mar. 17, 2000).
Santos et al., Cyclization-Activated Prodrugs. Synthesis, Reactivity and Toxicity of Dipeptide Esters of Paracetamol, Bioorganic & Medicinal Chemistry Letters 15: 1595-1598 (2005).
Schafmeister et al., "An All-Hydrocarbon Cross-Linking System for Enhancing the Helicity and Metaboli Stability of Peptides", J. Am. Chem. Soc. 122: 5891-5892 (2000).
Walensky et al., "Activation of Apoptosis in Vivo by a Hydrocarbon-Stapled BH3 Helix", Science 205: 1466-1470 (Sep. 3, 2004).
Lebl, Michal, "Peptides: Breaking Away: The Proceedings of the Twenty-First American Peptide Symposium", Prompt Scientific Publishing (2009).
"Legacy Products—'Back to the Future'," presentation to Eli Lilly and Co., Sep. 22, 2005.
"Application of Chemical Biotechnology to Optimization of Endocrine Hormones," Carothers Lecture, Mar. 22, 2007.
"The Emergence of Chemical Biotechnology & Its Application to Optimization of Endocrine Hormones," UMBC presentation, Mar. 26, 2008.
"Emergence of Chemical Biotechnology," Eli Lilly and Co. presentation, Jun. 22, 2009.
"Novel Glucagon-Like Chimera Peptides—Virtues of Combinatorial Pharmacology," Keystone Conference, Apr. 12-17, 2010, Whistler, B.C.
"Novel Glucagon-Like Chimera Peptides—Virtues of Combinatorial Pharmacology," AAPS May 2010.
"Two for the Money Gut Hormone Hybrids," Tschoep, ADA meeting, Jun. 25-29, 2010, Orlando, FL.
"Biotechnology—A Basis for Better Health & Economic Prosperity," Ohio State University presentation, Aug. 28, 2010.
"Novel Glucagon-Based Peptides—Virtues of Combinatorial Pharmacology," European Peptide Symposium, Sep. 5-9, 2010, Copenhagen, Denmark.

(56) References Cited

OTHER PUBLICATIONS

"Biotechnology—A Basis for Better Health & Economic Prosperity," Indiana University television presentation, Nov. 2010.
"Novel Glucagon-Based Peptides—Virtues of Combinatorial Pharmacology," University of Michigan, Oct. 13, 2010.
"Novel Glucagon-Based Peptides—Virtues of Combinatorial Pharmacology," Yale University, May 13, 2011.
"Speaking From the Gut: From Gastrointestinal Hormones to Combinatorial Therapies," Presentation to American Diabetes Association, Jun. 25, 2011.
"The Pursuit of Transformational Medicines," presentation to American Peptide Symposium, Jun. 25-30, 2011, San Diego, CA.
"The Pursuit of Transformational Medicines," NP2D presentation, Dec. 4, 2011.
"The Pursuit of Transformational Medicines," Keystone presentation, Jan. 29-Feb. 3, 2012, Santa Fe, NM.
"Novel Glucagon Peptides That Demonstrate The Virtues of Combinatorial Pharmacology," University of Toledo, Mar. 22, 2012.
Althage et al.,JBC "Targeted Ablation of GIP-Producing Cells in Transgenic mice reduces obesity and insulin resistance induced by a high fat diet" 2008).
Chia et al., "Exogenous glucose-dependent insulinotropic polypeptide worsens post-prandial hyperglycemia in type 2 diabetes," Diabetes, 58: 1342-1349 (2009).
Drucker, "Glucagon Gene Expression in Vertebrate Brain," The Journal of Biological Chemistry, vol. 263, No. 27, pp. 13475-13478, 1988.
Drucker, "The biology of incretin hormones," Cell Metabolism 3:153-165 (2006).
PCT International Search Report for PCT/US2009/034448 completed by the US Searching Authority on Jun. 4, 2010.
PCT International Search Report for PCT/US2009/068678 completed by the US Searching Authority on May 5, 2010.
Pan et al., "Synthesis of Cetuximab-Immunoliposomes via a Cholesterol-Based Membrane Anchor for Targeting of EGFR," Bioconjugate Chem., 18, pp. 101-108, 2007.
PCT International Search Report for PCT/US2009/047447 completed by the US Searching Authority on Mar. 19, 2010.
Collie et al., "Purification and sequence of rat oxyntomodulin," Proc. Natl. Acad. Sci. USA, vol. 91, pp. 9362-9366, Sep. 1994.
Sueiras-Diaz et al., "Structure-Activity Studies on the N-Terminal Region of Glucagon," J. Med. Chem., 27, pp. 310-315, 1984.
Hjorth et al., "glucagon and Glucagon-like Peptide 1: Selective Receptor Recognition via Distinct Peptide Epitopes," The Journal of Biological Chemistry, vol. 269, No. 48, pp. 30121-30124, Dec. 2, 1994.
Unson et al., "Role of Histidine-1 in Glucagon Action," Archives of Biochemistry and Biophysics, vol. 300, No. 2, pp. 747-750, Feb. 1, 1993.
Sato, H., "Enzymatic procedure for site-specific pegylation of proteins," Advanced Drug Delivery Reviews 54, pp. 487-504 (2002).
"Novel Glucagon-Like Chimera Peptides—Virtues of Combinatorial Pharmacology," University of Cincinnati, Jun. 2010.
"Molecular Miracles," Indiana University, Apr. 13, 2011.
"Novel Glucagon-Based Peptides—Virtues of Combinatorial Pharmacology," Aug. 31, 2011, Berlin.
Ward, "Fatty Acid Acylation of Peptides: Developing strategies to enhance medicines for treating metabolic disorders," Jan. 14, 2009.
DiMarchi, "Peptides—Development of Prodrug Chemistry," RBF Symposium Feb. 1-4, 2011 India.
Tschoep, "CNS Integration of Systems Metabolism: Target Opportunities for Diabetes Prevention and Therapy," RBF Symposium Feb. 1-4, 2011 India.
Yang et al., "Synthesis and Biological Assessment of Sulfonic Acid-Based Glucagon Antagonists," American Peptide Society, 2005.
Yang et al., "A Novel Approach to Resin-Based Cysteine Alkylation," American Peptide Society, 2005.
Yang et al., "Synthesis and Biological Assessment of Sulfonic Acid-Based Glucagon Antagonists," poster presentation to American Peptide Society, 2005.
Yang et al., "A Novel Approach to Resin-Based Cysteine Alkylation," poster presentation to American Peptide Society, 2005.
PCT International Search Report for PCT/US2010/038825 completed by the US Searching Authority on Sep. 15, 2010.
PCT International Search Report for PCT/US2010/059724 completed by the US Searching Authority on Jun. 14, 2011.
Wibowo, Synthesis, Purification , and Biological Activity of AIB Substituted Glucagon and GLP-1 Peptide Analogues (2005-2006) vol. 45, 707=738, accessed https://scholarworks.iu.edu/dspce/handle/2022/326 on Jul. 17, 2012.
O'Brien, Assay for DPPIV Activity using Homogenous, Luminescent Method, Cell Notes 2005, 11:8-11.
Evans et al., "Effect of β-Endorphin C-Terminal Peptides on Glucose Uptake in Isolated Skeletal Muscles of the Mouse," Peptides, vol. 18, No. 1, pp. 165-167, (1997).
Hansen et al., "Incretin hormones and insulin sensitivity," Trends in Endocrinology and Metabolism, vol. 16, No. 4, May/Jun. 2005, pp. 135-136.
Jen Holst "The Physiology of Glucagon-like Peptide-1", Physiological Reviews, V. 87, No. 4, pp. 1409-1439 (Oct. 2007).
Database Geneseq [Online] Feb. 16, 2012, Human glucagonanalog peptide SEQ:495, XP002710329, EBI accession No. GSP: AZQ99373, Database accession No. AZQ99373.
Azizeh et al., "The role of phenylalanine at position 6 in glucagon's mechanism of biological action: multiple replacement analogues of glucagon" J Med Chem 1997, 40, 2555-2562.
Supplemental EP Search report for EP09800752 completed on Jul. 20, 2011.
"Novel Glucagon-Like Chimera Peptides—Virtues of Combinatorial Pharmacology," AAPS 2005 San Francisco.
Zhou et al., "Peptide and protein drugs: I. Therapeutic applications, absorption and parenteral administration," International Journal of Pharmaceutics vol. 75 p. 97-111 (Sep. 20, 1991).

GLUCAGON ANTAGONIST-GIP AGONIST CONJUGATES AND COMPOSITIONS FOR THE TREATMENT OF METABOLIC DISORDERS AND OBESITY

CROSS REFERENCE TO RELATED APPLICATIONS

This application is a continuation of U.S. application Ser. No. 13/575,363, filed Jul. 26, 2012, which is a U.S. national counterpart application of international Application Serial No. PCT/US2011/022608 filed Jan. 26, 2011, which claims priority to U.S. Provisional Patent Application No. 61/298,812 filed Jan. 27, 2010. The entire disclosures of PCT/US2011/022608 and U.S. Ser. No. 61/298,812 are hereby incorporated by reference.

INCORPORATION BY REFERENCE OF MATERIAL SUBMITTED ELECTRONICALLY

Incorporated by reference in its entirety is a computer-readable nucleotide/amino acid sequence listing (organized into Sequence Listings 1-5, as described herein) submitted concurrently herewith and identified as follows: One 723,000 byte ACII (Text) file named sub226616_ST25.txt created on Mar. 31, 2016.

BACKGROUND

Glucose-dependent insulinotropic peptide (GIP) and Glucagon-like Peptide-1 (GLP-1) are incretins which regulate the amount of insulin that is secreted after eating (Kim and Egan, *Pharm Rev* 60:470-512 (2008)). In specific, GIP exerts glucose-dependent stimulatory effects on insulin secretion, thereby ensuring prompt insulin-mediated uptake of glucose into tissues, and GLP-1 stimulates insulin synthesis and secretion, inhibition of glucagon secretion, and inhibition of food intake. While agonist peptide analogs of both incretins have been made and tested, GLP-1 agonists have been and remain the central focus of research and development for treating of metabolic diseases, such as Type 2 diabetes. This is not surprising, since in Type 2 diabetes, GIP no longer modulates glucose-dependent insulin secretion, whereas GLP-1 retains insulinotropic activities even in Type 2 diabetetic patients. Also, research by some groups McLean et al., *Am J Physiol Endocrinol Metab* 296(6): E1746-1755 (epub 2007) have suggested the use of GIP antagonists and not GIP agonists for the treatment of diabetes.

When blood glucose levels begin to fall, glucagon is produced by the pancreas and the binding of this hormone to its receptor signals the liver to break down glycogen and release glucose. The actions of glucagon cause blood glucose levels to rise toward a normal level. Because glucagon exerts actions which oppose incretins, many glucagon antagonists have been made and tested for the treatment of metabolic diseases, including Type 2 diabetes.

SUMMARY

Provided herein are peptide combinations useful for the treatment of diseases, such as metabolic disorders (e.g., diabetes, obesity). The peptide combinations comprise a GIP agonist peptide which exhibits agonist activity at the GIP receptor and a glucagon antagonist peptide which exhibits antagonist or inhibitory activity at the glucagon receptor. In specific aspects, the GIP agonist peptide exhibits at least 0.1% activity (e.g., at least 0.5%, at least 0.75%, at least 1%, at least 5%, at least 10%) of native GIP at the GIP receptor and the glucagon antagonist peptide exhibits at least 60% inhibition of the maximum response achieved by glucagon at the glucagon receptor. In specific aspects, the IC50 at the glucagon receptor of the glucagon antagonist peptide is within about 10-fold (higher or lower) of the EC50 at the GIP receptor of the GIP agonist peptide. In exemplary embodiments, either or both of the GIP agonist peptide and glucagon antagonist peptide additionally exhibit agonist activity at the GLP-1 receptor.

In some embodiments, the peptide combinations are provided as a composition, such as, for example, a pharmaceutical composition. In some aspects, the composition comprises the GIP agonist peptide in admixture with the glucagon antagonist peptide and the two peptides are not attached to one another.

In some embodiments, the peptide combinations are provided as a conjugate in which the GIP agonist peptide is attached via covalent or non-covalent bonds (or a mixture of both types of bonds) to the glucagon antagonist peptide. In certain embodiments, the GIP agonist peptide is covalently attached to the glucagon antagonist peptide via peptide bonds. In some aspects, the conjugate is a single polypeptide chain (e.g., a fusion peptide) comprising the GIP agonist peptide and glucagon antagonist peptide. In specific aspects, the fusion peptide can be produced recombinantly. In alternative aspects, the GIP agonist peptide is attached to the glucagon antagonist peptide via one or more side chain functional groups of one or more amino acids of the GIP agonist peptide and/or glucagon antagonist peptide. In some aspects, the conjugate is a heterodimer (or multimer) comprising the GIP agonist peptide and glucagon antagonist peptide attached to one another. In specific aspects, such as any of the above aspects, the GIP agonist peptide is attached to the glucagon antagonist peptide via a linker, e.g., a bifunctional linker. In some aspects, the bifunctional linker is a hydrophilic polymer, e.g., polyethylene glycol. In certain specific aspects, the bifunctional linker connects a Cys residue of one of the GIP agonist peptide and glucagon antagonist peptide to a Lys of the other peptide. In certain embodiments of the present disclosures, each of the Cys and Lys is located at the C-terminus of the peptide or within the C-terminal region of the peptide.

In some embodiments, the peptide combination is provided as a kit. In some aspects, the GIP agonist peptide is packaged together with the glucagon antagonist peptide. In alternative aspects, the GIP agonist peptide is packaged separately from the glucagon antagonist peptide. The kit in some aspects comprises instructions for administering the GIP agonist peptide and glucagon antagonist peptide. In some aspects, the kit comprises instructions for co-administering the GIP agonist peptide and glucagon antagonist peptide.

The present disclosures therefore provides compositions (e.g., pharmaceutical compositions), conjugates (e.g., fusion peptides, heterodimers), and kits, each of which comprise a GIP agonist peptide and a glucagon antagonist peptide. Methods of using such compositions, conjugates, and kits are further provided herein. For example, the present disclosures provide a method of treating a metabolic disease (e.g., diabetes, obesity) in a patient, comprising administering to the patient any of the compositions or conjugates described herein in an amount effective to treat the metabolic disease in the patient. The treatment of other diseases is further contemplated herein.

DETAILED DESCRIPTION OF THE PRESENT DISCLOSURES

Definitions

Figure 1:
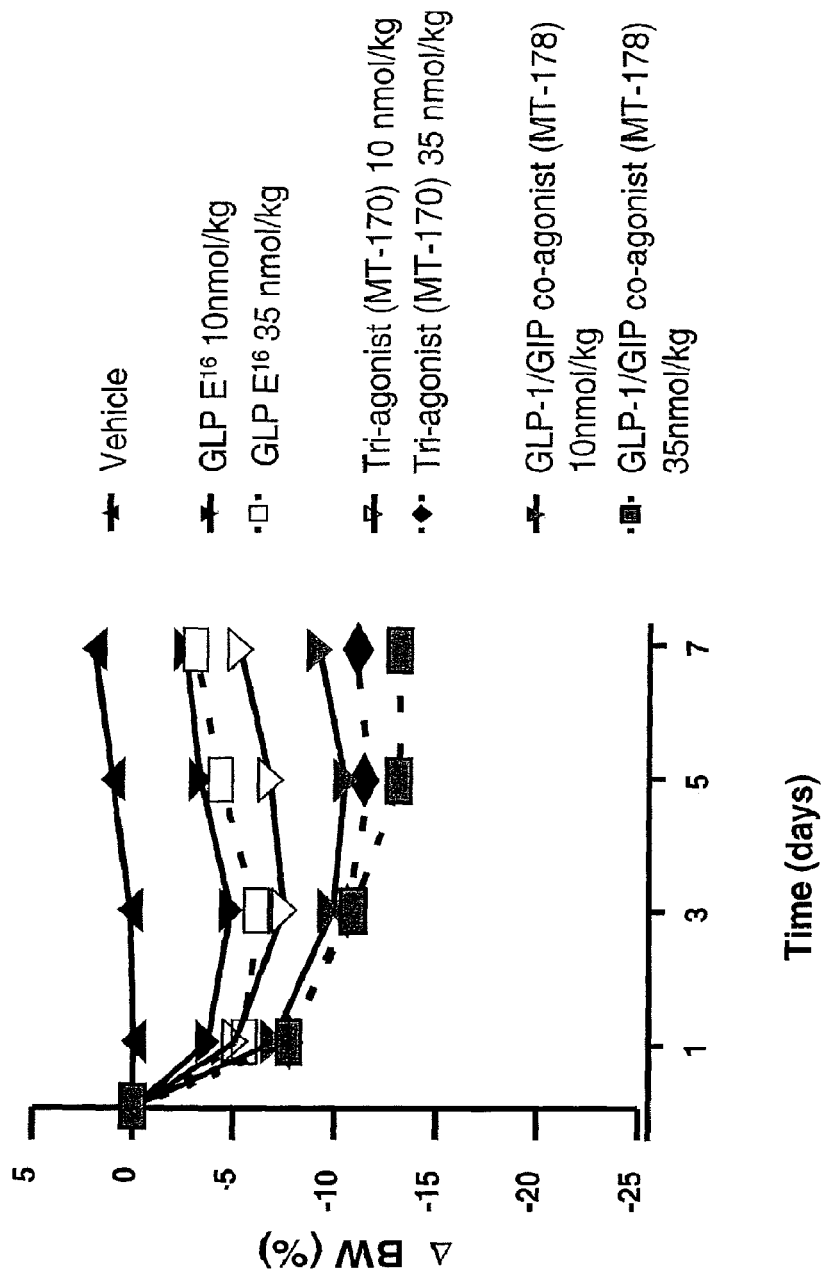
FIG. 1 is a graph of the % change in body weight in mice as a function of time (days) after administration of vehicle alone (closed upright triangles), GLP-1 E 16 agonist at 10 nmol/kg (closed inverted triangles) or 35 nmol/kg (open squares), triagonist peptide MT-170 at 10 nmol/kg (open inverted triangles) or 35 nmol/kg (closed diamonds), or GLP-1/GIP co-agonist peptide MT-178 at 10 nmol/kg (grey inverted triangles) or at 35 nmol/kg (grey squares).

The term "about" as used herein means greater or lesser than the value or range of values stated by 10 percent, but is not intended to designate any value or range of values to only this broader definition. Each value or range of values preceded by the term "about" is also intended to encompass the embodiment of the stated absolute value or range of values.

As used herein, the term "pharmaceutically acceptable carrier" includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

As used herein the term "pharmaceutically acceptable salt" refers to salts of compounds that retain the biological activity of the parent compound, and which are not biologically or otherwise undesirable. Many of the compounds disclosed herein are capable of forming acid and/or base salts by virtue of the presence of amino and/or carboxyl groups or groups similar thereto.

Pharmaceutically acceptable base addition salts can be prepared from inorganic and organic bases. Salts derived from inorganic bases, include by way of example only, sodium, potassium, lithium, ammonium, calcium and magnesium salts. Salts derived from organic bases include, but are not limited to, salts of primary, secondary and tertiary amines. Pharmaceutically acceptable acid addition salts may be prepared from inorganic and organic acids. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like.

As used herein, the term "treating" includes prophylaxis of the specific disorder or condition, or alleviation of the symptoms associated with a specific disorder or condition and/or preventing or eliminating said symptoms. For example, as used herein the term "treating diabetes" will refer in general to altering glucose blood levels in the direction of normal levels and may include increasing or decreasing blood glucose levels depending on a given situation.

As used herein an "effective" amount or a "therapeutically effective amount" of a glucagon peptide refers to a nontoxic but sufficient amount of the peptide to provide the desired effect. For example one desired effect would be the prevention or treatment of hypoglycemia, as measured, for example, by an increase in blood glucose level. An alternative desired effect for the glucagon peptides of the present disclosure would include treating hyperglycemia, e.g., as measured by a change in blood glucose level closer to normal, or inducing weight loss/preventing weight gain, e.g., as measured by reduction in body weight, or preventing or reducing an increase in body weight, or normalizing body fat distribution. The amount that is "effective" will vary from subject to subject, depending on the age and general condition of the individual, mode of administration, and the like. Thus, it is not always possible to specify an exact "effective amount." However, an appropriate "effective" amount in any individual case may be determined by one of ordinary skill in the art using routine experimentation.

The term, "parenteral" means not through the alimentary canal but by some other route, e.g., subcutaneous, intramuscular, intraspinal, or intravenous.

The term "isolated" as used herein means having been removed from its natural environment. In some embodiments, the analog is made through recombinant methods and the analog is isolated from the host cell.

The term "purified," as used herein relates to the isolation of a molecule or compound in a form that is substantially free of contaminants normally associated with the molecule or compound in a native or natural environment and means having been increased in purity as a result of being separated from other components of the original composition. The term "purified polypeptide" is used herein to describe a polypeptide which has been separated from other compounds including, but not limited to nucleic acid molecules, lipids and carbohydrates.

As used herein, the term "peptide" encompasses a sequence of 2 or more amino acids and typically less than 50 amino acids, wherein the amino acids are naturally occurring or coded or non-naturally occurring or non-coded amino acids. Non-naturally occurring amino acids refer to amino acids that do not naturally occur in vivo but which, nevertheless, can be incorporated into the peptide structures described herein. "Non-coded" as used herein refer to an amino acid that is not an L-isomer of any of the following 20 amino acids: Ala, Cys, Asp, Glu, Phe, Gly, His, Ile, Lys, Leu, Met, Asn, Pro, Gln, Arg, Ser, Thr, Val, Trp, Tyr.

As used herein, the terms "polypeptide" and "protein" are terms that are used interchangeably to refer to a polymer of amino acids, without regard to the length of the polymer. Typically, polypeptides and proteins have a polymer length that is greater than that of "peptides." In some instances, a protein comprises more than one polypeptide chain covalently or noncovalently attached to each other.

As used herein, a "peptide combination" encompasses a composition, conjugate, or kit comprising a GIP agonist peptide and a glucagon antagonist peptide. The GIP agonist peptide and a glucagon antagonist peptide may be separated or mixed together, or may be linked covalently or non-covalently. When the peptides are linked covalently or non-covalently, the peptide combination is referred to as a "conjugate."

Throughout the application, all references to a particular amino acid position by number (e.g., position 28) refer to the amino acid at that position in native glucagon (SEQ ID NO: 1) or the corresponding amino acid position in any analogs thereof. For example, a reference herein to "position 28" would mean the corresponding position 27 for an analog of glucagon in which the first amino acid of SEQ ID NO: 1 has been deleted. Similarly, a reference herein to "position 28" would mean the corresponding position 29 for a analog of glucagon in which one amino acid has been added before the N-terminus of SEQ ID NO: 1.

As used herein an "amino acid modification" refers to (i) a substitution or replacement of an amino acid of SEQ ID NO: 1 with a different amino acid (naturally-occurring or coded or non-coded or non-naturally-occurring amino acid), (ii) an addition of an amino acid (naturally-occurring or coded or non-coded or non-naturally-occurring amino acid), to SEQ ID NO: 1 or (iii) a deletion of one or more amino acids of SEQ ID NO: 1.

In some embodiments, the amino acid substitution or replacement is a conservative amino acid substitution, e.g., a conservative substitution of the amino acid at one or more of positions 2, 5, 7, 10, 11, 12, 13, 14, 16, 17, 18, 19, 20, 21, 24, 27, 28 or 29. As used herein, the term "conservative amino acid substitution" is the replacement of one amino acid with another amino acid having similar properties, e.g., size, charge, hydrophobicity, hydrophilicity, and/or aromaticity, and includes exchanges within one of the following five groups:

I. Small aliphatic, nonpolar or slightly polar residues:
Ala, Ser, Thr, Pro, Gly;
II. Polar, negative-charged residues and their amides and esters:
Asp, Asn, Glu, Gln, cysteic acid and homocysteic acid;
III. Polar, positive-charged residues:
His, Arg, Lys; Ornithine (Orn)
IV. Large, aliphatic, nonpolar residues:
Met, Leu, Ile, Val, Cys, Norleucine (Nle), homocysteine
V. Large, aromatic residues:
Phe, Tyr, Trp, acetyl phenylalanine In some embodiments, the amino acid substitution is not a conservative amino acid substitution, e.g., is a non-conservative amino acid substitution.

As used herein the term "charged amino acid" refers to an amino acid that comprises a side chain that is negative-charged (i.e., de-protonated) or positive-charged (i.e., protonated) in aqueous solution at physiological pH. For example negative-charged amino acids include aspartic acid, glutamic acid, cysteic acid, homocysteic acid, and homoglutamic acid, whereas positive-charged amino acids include arginine, lysine and histidine. Charged amino acids include the charged amino acids among the 20 coded amino acids, as well as atypical or non-naturally occurring or non-coded amino acids.

As used herein the term "acidic amino acid" refers to an amino acid that comprises a second acidic moiety (other than the alpha carboxylic acid of the amino acid), including for example, a side chain carboxylic acid or sulfonic acid group.

As used herein a "sulfonic acid derivative of cysteine" refers to compounds of the general structure:

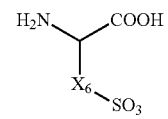

wherein $X_6$ is $C_1$-$C_4$ alkyl, $C_2$-$C_4$ alkenyl or $C_2$-$C_4$ alkynyl.

The term "$C_1$-$C_n$ alkyl" wherein n can be from 1 through 6, as used herein, represents a branched or linear alkyl group having from one to the specified number of carbon atoms. Typical $C_1$-$C_6$ alkyl groups include, but are not limited to, methyl, ethyl, n-propyl, iso-propyl, butyl, iso-butyl, sec-butyl, tert-butyl, pentyl, hexyl and the like.

The terms "$C_2$-$C_n$ alkenyl" wherein n can be from 2 through 6, as used herein, represents an olefinically unsaturated branched or linear group having from 2 to the specified number of carbon atoms and at least one double bond. Examples of such groups include, but are not limited to, 1-propenyl, 2-propenyl (—CH$_2$—CH═CH$_2$), 1,3-butadienyl, (—CH═CHCH═CH$_2$), 1-butenyl (—CH═CHCH$_2$CH$_3$), hexenyl, pentenyl, and the like.

The term "C$_2$-C$_n$ alkynyl" wherein n can be from 2 to 6, refers to an unsaturated branched or linear group having from 2 to n carbon atoms and at least one triple bond. Examples of such groups include, but are not limited to, 1-propynyl, 2-propynyl, 1-butynyl, 2-butynyl, 1-pentynyl, and the like.

As used herein the term "pH stabilized glucagon antagonist" refers to a glucagon antagonist that exhibits superior stability and solubility, relative to native glucagon, in aqueous buffers in the broadest pH range used for pharmacological purposes.

As used herein, the term "selectivity" of a molecule for a first receptor relative to a second receptor refers to the following ratio: EC50 of the molecule at the second receptor divided by the EC50 of the molecule at the first receptor. For example, a molecule that has an EC50 of 1 nM at a first receptor and an EC50 of 100 nM at a second receptor has 100-fold selectivity for the first receptor relative to the second receptor.

As used herein the term "native glucagon" refers to a peptide consisting of the sequence of SEQ ID NO: 1 and the term "native GLP-1" is a generic term that designates GLP-1(7-36) amide, GLP-1(7-37) acid or a mixture of those two compounds. As used herein, the term "native GIP" refers to a peptide consisting of SEQ ID NO: 2.

As used herein, "GIP potency" or "potency compared to native GIP" of a molecule refers to the ratio of the EC50 of the molecule at the GIP receptor divided by the EC50 of native GIP at the GIP receptor.

As used herein, "glucagon potency" or "potency compared to native glucagon" of a molecule refers to the ratio of the EC50 of the molecule at the glucagon receptor divided by the EC50 of native glucagon at glucagon receptor.

As used herein, "GLP-1 potency" or "potency compared to native GLP-1" of a molecule refers to the ratio of the EC50 of the molecule at GLP-1 receptor divided by the EC50 of native GLP-1 at GLP-1 receptor.

The term "GIP agonist peptide" refers to a compound that binds to and activates downstream signaling of the GIP receptor. However, this term should not be construed as limiting the compound to having activity at only the GIP receptor. Rather, the GIP agonist peptides of the present disclosures may exhibit additional activities at other receptors, as further discussed herein. GIP agonist peptides, for example, may exhibit activity (e.g., agonist activity) at the GLP-1 receptor. Also, the term "GIP agonist peptide" should not be construed as limiting the compound to only peptides. Rather, compounds other than peptides are encompassed by this term. Accordingly, the GIP agonist peptide in some aspects is a peptide in conjugate form (a heterodimer, a multimer, a fusion peptide), a chemically-derivatized peptide, a pharmaceutical salt of a peptide, a peptidomimetic, and the like.

The term "glucagon antagonist peptide" refers to a compound that counteracts glucagon activity or prevents glucagon function. For example, a glucagon antagonist exhibits at least 60% inhibition (e.g., at least 70% inhibition) and preferably, at least 80% inhibition, of the maximum response achieved by glucagon at the glucagon receptor. In one embodiment, the glucagon antagonist exhibits at least 90% inhibition of the maximum response achieved by glucagon at the glucagon receptor. In a specific embodiment, the glucagon antagonist exhibits 100% inhibition of the maximum response achieved by glucagon at the glucagon receptor. Additionally, a glucagon antagonist at a concentration of about 1 μM exhibits less than about 20% of the maximum agonist activity achieved by glucagon at the glucagon receptor. In one embodiment, the glucagon antagonist exhibits less than about 10% of the maximum agonist activity achieved by glucagon at the glucagon receptor. In a specific embodiment, the glucagon antagonist exhibits less than about 5% of the maximum agonist activity achieved by glucagon at the glucagon receptor. In yet another specific embodiment, the glucagon antagonist exhibits 0% of the maximum agonist activity achieved by glucagon at the glucagon receptor.

The term "glucagon antagonist peptide" should not be construed as limiting the compound to having activity at only the glucagon receptor. Rather, the glucagon antagonist peptides of the present disclosures may exhibit additional activities at the glucagon receptor (e.g., partial agonism) or other receptor. Glucagon antagonist peptides, for example, may exhibit activity (e.g., agonist activity) at the GLP-1 receptor. Also, the term "glucagon antagonist peptide" should not be construed as limiting the compound to only peptides. Rather, compounds other than peptides are encompassed by these terms. Accordingly, in some aspects, the GIP agonist peptide is a peptide in conjugate form, a chemi]cally-derivatized peptide, a pharmaceutical salt of a peptide, a peptidomimetic, and the like.

A "pure glucagon antagonist" is a glucagon antagonist that does not produce any detected stimulation of glucagon or GLP-1 receptor activity, as measured by cAMP production using a validated in vitro model assay, such as that described in Example 2. For example, a pure glucagon antagonist exhibits less than about 5% (e.g., less than about 4%, less than about 3%, less than about 2%, less than about 1%, about 0%) of the maximum agonist activity achieved by glucagon at the glucagon receptor and exhibits less than about 5% (e.g., less than about 4%, less than about 3%, less than about 2%, less than about 1%, and about 0%) of the maximum agonist activity achieved by GLP-1 at the GLP-1 receptor.

EMBODIMENTS

Peptide Combinations

The present disclosures provide peptide combinations comprising a GIP agonist peptide and a glucagon antagonist peptide. The activity of the GIP agonist peptide at the GIP receptor can be in accordance with any of the teachings set forth herein. Likewise, the activity of the glucagon antagonist peptide at the glucagon receptor can be in accordance with any of the teachings set forth herein. In specific aspects, the GIP agonist peptide exhibits at least 0.1% activity of native GIP at the GIP receptor and the glucagon antagonist peptide exhibits at least 60% inhibition of the maximum response achieved by glucagon at the glucagon receptor.

In specific aspects, the IC50 of the glucagon antagonist peptide at the glucagon receptor is within about 50-fold (e.g., within about 40-fold, within about 30-fold, within about 20-fold, within about 10-fold, within about 5-fold, within about 2-fold) of the EC50 at the GIP receptor of the GIP agonist peptide. In some embodiments, the EC50 at the GIP receptor of the GIP agonist peptide is greater than the IC50 of the glucagon antagonist peptide at the glucagon peptide. In alternative aspects, the EC50 at the GIP receptor of the GIP agonist peptide is less than the IC50 of the glucagon antagonist peptide at the glucagon peptide. In certain aspects, the IC50 of the glucagon antagonist peptide at the glucagon receptor divided by the EC50 of the GIP agonist peptide at the GIP receptor is less than or about 100, 75, 60, 50, 40, 30, 20, 15, 10, or 5, and no less than 1. In certain aspects, the EC50 of the GIP agonist peptide at the GIP receptor divided by the IC50 of the glucagon antagonist peptide at the glucagon receptor is less than or about 100, 75, 60, 50, 40, 30, 20, 15, 10, or 5, and no less than 1.

In exemplary embodiments, either or both of the GIP agonist peptide and glucagon antagonist peptide additionally exhibit agonist activity at the GLP-1 receptor. The activity at the GLP-1 receptor of either or both of the GIP agonist peptide and glucagon antagonist peptide may be in accordance with any of the teachings described herein.

In some embodiments, the peptide combinations are provided as a composition, such as, for example, a pharmaceutical composition. In some aspects, the GIP agonist peptide is in admixture with the glucagon antagonist peptide. The pharmaceutical composition in some aspects comprises a pharmaceutical acceptable carrier.

In some embodiments, the peptide combinations are provided as a conjugate in which the GIP agonist peptide is attached via covalent or non-covalent bonds (or a mixture of both types of bonds) to the glucagon antagonist peptide. In certain embodiments, the GIP agonist peptide is covalently attached to the glucagon antagonist peptide via peptide bonds. In some aspects, the conjugate is a single polypeptide chain (e.g., a fusion peptide) comprising the GIP agonist peptide and glucagon antagonist peptide. In specific aspects, the fusion peptide can be produced recombinantly. In alternative aspects, the GIP agonist peptide is attached to the glucagon antagonist peptide via one or more side chain functional groups of one or more amino acids of the GIP agonist peptide and/or glucagon antagonist peptide. In some aspects, the conjugate is a heterodimer (or multimer) comprising the GIP agonist peptide and glucagon antagonist peptide attached to one another. In specific aspects, the GIP agonist peptide is attached to the glucagon antagonist peptide via a linker, e.g., a bifunctional linker. In some aspects, the bifunctional linker is a hydrophilic polymer, e.g., polyethylene glycol. In certain specific aspects, the bifunctional linker connects a Cys residue of one of the GIP agonist peptide and glucagon antagonist peptide to a Lys of the other peptide. In certain embodiments of the present disclosures, each of the Cys and Lys is located at the C-terminus of the peptide or within the C-terminal region of the peptide.

In some embodiments, the peptide combination is provided as a kit. In some aspects, the GIP agonist peptide is packaged together with the glucagon antagonist peptide. In alternative aspects, the GIP agonist peptide is packaged separately from the glucagon antagonist peptide. The kit in some aspects comprises instructions of administering the GIP agonist peptide and glucagon antagonist peptide.

The GIP agonist peptide and glucagon antagonist peptide may be co-administered together or separately, simultaneously or sequentially (so long as both peptides exert the desired activity during an overlapping time period). Methods of co-administering the GIP agonist peptide and glucagon antagonist peptide for therapeutic purpose(s) are provided herein. Also provided are the use of a GIP agonist peptide in the preparation of a medicament for co-administration with a glucagon antagonist peptide and the use of a glucagon antagonist peptide in the preparation of a medicament for co-administration with a GIP agonist peptide.

Each of the foregoing peptide combinations comprising a GIP agonist peptide and a glucagon antagonist peptide, as well as their methods of use, is further described herein.

Activity of the GIP Agonist Peptide
GIP Receptor Agonism

In some embodiments of the present disclosures, the GIP agonist peptide exhibits at least or about 0.1% activity of native GIP at the GIP receptor. In exemplary embodiments, the GIP agonist peptide exhibits at least or about 0.2%, at least or about 0.3%, at least or about 0.4%, at least or about 0.5%, at least or about 0.6%, at least or about 0.7%, at least or about 0.8%, at least or about 0.9%, at least or about 1%, at least or about 5%, at least or about 10%, at least or about 20%, at least or about 30%, at least or about 40%, at least or about 50%, at least or about 60%, at least or about 70%, at least or about 75%, at least or about 80%, at least or about 90%, at least or about 95%, or at least or about 100% of the activity of native GIP at the GIP receptor.

In some embodiments of the present disclosures, the GIP agonist peptide exhibits activity at the GIP receptor which is greater than that of native GIP. In exemplary embodiments, the GIP agonist peptide exhibits at least or about 101%, at least or about 105%, at least or about 110%, at least or about 125%, at least or about 150%, at least or about 175% at least or about 200%, at least or about 300%, at least or about 400%, at least or about 500% or higher % of the activity of native GIP at the GIP receptor. In some embodiments, the GIP agonist peptides described herein exhibit no more than 1000%, 10,000%, 100,000%, or 1,000,000% activity at the GIP receptor relative to native GIP. A peptide's activity at the GIP receptor relative to native GIP is calculated as the inverse ratio of EC50s for the GIP agonist peptide vs. native GIP. In some embodiments, the GIP agonist peptide exhibits an EC50 for GIP receptor activation which is in the nanomolar range. In exemplary embodiments, the EC50 of the GIP agonist peptide at the GIP receptor is less than 1000 nM, less than 900 nM, less than 800 nM, less than 700 nM, less than 600 nM, less than 500 nM, less than 400 nM, less than 300 nM, less than 200 nM. In some embodiments, the EC50 of the peptide at the GIP receptor is about 100 nM or less, e.g., about 75 nM or less, about 50 nM or less, about 25 nM or less, about 10 nM or less, about 8 nM or less, about 6 nM or less, about 5 nM or less, about 4 nM or less, about 3 nM or less, about 2 nM or less, or about 1 nM or less. In some embodiments, the GIP agonist peptide exhibits an EC50 for GIP receptor activation which is in the picomolar range. In exemplary embodiments, the EC50 of the GIP agonist peptide at the GIP receptor is less than 1000 pM, less than 900 pM, less than 800 pM, less than 700 pM, less than 600 pM, less than 500 pM, less than 400 pM, less than 300 pM, less than 200 pM. In some embodiments, the EC50 of the peptide at the GIP receptor is about 100 pM or less, e.g., about 75 pM or less, about 50 pM or less, about 25 pM or less, about 10 pM or less, about 8 pM or less, about 6 pM or less, about 5 pM or less, about 4 pM or less, about 3 pM or less, about 2 pM or less, or about 1 pM or less. Receptor activation can be measured by in vitro assays measuring cAMP induction in HEK293 cells over-expressing the GIP receptor, e.g. assaying HEK293 cells co-transfected with DNA encoding the receptor and a luciferase gene linked to cAMP responsive element as described in Example 2.

Activity at the Glucagon Receptor

In many aspects of the present disclosures, the GIP agonist peptide does not activate the glucagon receptor to any appreciable degree. Accordingly, in some embodiments, the GIP agonist peptide is a GIP agonist which exhibits about 10% or less (e.g., about 9% or less, about 8% or less, about 7% or less, about 6% or less, about 5% or less, about 4% or less, about 3% or less, about 2% or less, about 1% or less) of the activity of native glucagon at the glucagon receptor.

Co-Agonism

In some embodiments of the present disclosures, the GIP agonist peptide is a co-agonist peptide insofar as it activates a second receptor different from the GIP receptor, in addition to the GIP receptor. By way of example, the GIP agonist peptide in some aspects exhibits activity at both the GIP receptor and the GLP-1 receptor ("GLP-1/GIP receptor co-agonists"). In some embodiments, the EC50 of the GIP agonist peptide at the GIP receptor is within about 50- or less fold (higher or lower) than the EC50 of the GIP agonist peptide at the GLP-1 receptor. In some embodiments, the EC50 of the GIP agonist peptide at the GIP receptor is within about 40-fold, about 30-fold, about 20-fold (higher or lower) from its EC50 at the GLP-1 receptor. In some embodiments, the GIP potency of the GIP agonist peptide is less than or about 25-, 20-, 15-, 10-, or 5-fold different (higher or lower) from its GLP-1 potency. In some embodiments, the ratio of the EC50 of the GIP agonist peptide at the GIP receptor divided by the EC50 of the GIP agonist peptide at the GLP-1 receptor is less than about 100, 75, 60, 50, 40, 30, 20, 15, 10, or 5, and no less than 1. In some embodiments, the ratio of the GIP potency of the GIP agonist peptide compared to the GLP-1 potency of the GIP agonist peptide is less than about 100, 75, 60, 50, 40, 30, 20, 15, 10, or 5, and no less than 1. In some embodiments, the ratio of the EC50 of the GIP agonist peptide at the GLP-1 receptor divided by the EC50 of the GIP agonist peptide at the GIP receptor is less than about 100, 75, 60, 50, 40, 30, 20, 15, 10, or 5, and no less than 1. In some embodiments, the ratio of the GLP-1 potency of the GIP agonist peptide compared to the GIP potency of the GIP agonist peptide is less than about 100, 75, 60, 50, 40, 30, 20, 15, 10, or 5, and no less than 1. In some embodiments, the selectivity of the GIP agonist peptide does not have at least 100-fold selectivity for the human GLP-1 receptor versus the GIP receptor. In exemplary embodiments, the selectivity of the GIP agonist peptide for the human GLP-1 receptor versus the GIP receptor is less than 100-fold (e.g., less than or about 90-fold, less than or about 80-fold, less than or about 70-fold, less than or about 60-fold, less than or about 50-fold, less than or about 40-fold, less than or about 30-fold, less than or about 20-fold, less than or about 10-fold, less than or about 5-fold).

In some embodiments of the present disclosures, the GIP agonist peptide exhibits at least or about 0.1% activity of native GLP-1 at the GLP-1 receptor. In exemplary embodiments, the GIP agonist peptide exhibits at least or about 0.2%, at least or about 0.3%, at least or about 0.4%, at least or about 0.5%, at least or about 0.6%, at least or about 0.7%, at least or about 0.8%, at least or about 0.9%, at least or about 1%, at least or about 5%, at least or about 10%, at least or about 20%, at least or about 30%, at least or about 40%, at least or about 50%, at least or about 60%, at least or about 70%, at least or about 75%, at least or about 80%, at least or about 90%, at least or about 95%, or at least or about 100% of the activity of native GLP-1 at the GLP-1 receptor.

In some embodiments, the GIP agonist peptide exhibits activity at only the GIP receptor, and not the GLP-1 receptor. In some embodiments, the GIP agonist peptide is a GIP agonist which exhibits about 10% or less (e.g., about 9% or less, about 8% or less, about 7% or less, about 6% or less, about 5% or less, about 4% or less, about 3% or less, about 2% or less, about 1% or less) of the activity of native GLP-1 at the glucagon GLP-1.

Activity of Conjugates

In some embodiments, when the GIP agonist peptide is conjugated to a heterologous moiety (e.g., a hydrophilic moiety), as further described herein, the GIP agonist peptide exhibits a decreased activity (e.g., a lower potency or higher EC50) than when the GIP agonist peptide is in a free or unconjugated form. In some aspects, when the GIP agonist peptide is free or unconjugated, the GIP agonist peptide exhibits a potency at the GIP receptor that is about 10-fold or greater than the potency of the GIP agonist peptide when the GIP agonist peptide is conjugated to a heterologous moiety (e.g., a hydrophilic moiety). In some aspects, when unconjugated, the GIP agonist peptide exhibits a potency at the GIP receptor that is about 10-fold, about 15-fold, about 20-fold, about 25-fold, about 30-fold, about 35-fold, about 40-fold, about 45-fold, about 50-fold, about 100-fold or more higher than the potency of the GIP agonist peptide when conjugated to a heterologous moiety. In some aspects, when unconjugated, the GIP agonist peptide exhibits a potency at the GIP receptor that is about 10-fold, about 15-fold, about 20-fold, about 25-fold, about 30-fold, about 35-fold, about 40-fold, about 45-fold, about 50-fold, about 100-fold or more higher than the potency of the GIP agonist peptide when conjugated to a glucagon antagonist peptide.

Structure of the GIP Agonist Peptide

Analogs of Native Human GIP

In some embodiments of the present disclosures, the GIP receptor agonist is an analog of native human GIP, the amino acid sequence of which is provided herein as SEQ ID NO: 2. Accordingly, in some embodiments, the GIP agonist peptide comprises an amino acid sequence which is based on the amino acid sequence of SEQ ID NO: 2 but is modified with 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.), amino acid modifications. In some embodiments, the GIP analog comprises a total of 1, up to 2, up to 3, up to 4, up to 5, up to 6, up to 7, up to 8, up to 9, or up to 10 amino acid modifications relative to the native human GIP sequence (SEQ ID NO: 2). In some embodiments, the modifications are any of those described herein, e.g., acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29. Exemplary GIP receptor agonists are known in the art. See, for example, Irwin et al., *J Pharm and Expmt Ther* 314(3): 1187-1194 (2005); Salhanick et al., *Bioorg Med Chem Lett* 15(18): 4114-4117 (2005); Green et al., *Diabetes* 7(5): 595-604 (2005); O'Harte et al., *J Endocrinol* 165(3): 639-648 (2000); O'Harte et al., *Diabetologia* 45(9): 1281-1291 (2002); Gault et al., *Biochem J.* 367 (Pt3): 913-920 (2002); Gault et al., *J Endocrin* 176: 133-141 (2003); Irwin et al., *Diabetes Obes Metab.* 11(6): 603-610 (epub 2009).

In some embodiments, the GIP agonist peptide of the present disclosures comprises an amino acid sequence which has at least 25% sequence identity to the amino acid sequence of native human GIP (SEQ ID NO: 2). In some embodiments, the GIP agonist peptide comprises an amino acid sequence which is at least 30%, at least 40%, at least 50%, at least 60%, at least 70%, at least 80%, at least 85%, at least 90% or has greater than 90% sequence identity to SEQ ID NO: 2. In some embodiments, the amino acid sequence of the GIP agonist peptide which has the above-referenced % sequence identity is the full-length amino acid sequence of the GIP agonist peptide. In some embodiments, the amino acid sequence of the GIP agonist peptide which has the above-referenced % sequence identity is only a portion of the amino acid sequence of the GIP agonist peptide. In some embodiments, the GIP agonist peptide comprises an amino acid sequence which has about A % or greater sequence identity to a reference amino acid sequence of at least 5 contiguous amino acids (e.g., at least 6, at least 7, at least 8, at least 9, at least 10 amino acids) of SEQ ID NO: 2, wherein the reference amino acid sequence begins with the amino acid at position C of SEQ ID NO: 2 and ends with the amino acid at position D of SEQ ID NO: 2, wherein A is 25, 30, 35, 40, 45, 50, 55, 60, 65, 70, 75, 80, 85, 90, 91, 92, 93, 94, 95, 96, 97, 98, 99; C is 1, 2, 3, 4, 5, 6, 7, 8, 9, 10, 11, 12, 13, 14, 15, 16, 17, 18, 19, 20, 21, 22, 23, 24, 25, 26, 27, or 28 and D is 5, 6, 7, 8, 9, 10, 11, 12, 13, 14, 15, 16, 17, 18, 19, 20, 21, 22, 23, 24, 25, 26, 27, 28 or 29. Any and all possible combinations of the foregoing parameters are envisioned, including but not limited to, e.g., wherein A is 90% and C and D are 1 and 27, or 6 and 27, or 8 and 27, or and 27, or 12 and 27, or 16 and 27.

In specific aspects, the GIP agonist peptide is an analog of native GIP comprising an amino acid modification at position 1, position 2, or at both positions 1 and 2, wherein the amino acid modification confers the peptide with increased resistance to DPP-IV protease cleavage. In some aspects, the amino acid modification which confers the peptide with increased resistance to DPP-IV protease cleavage are any of those described herein with regard to analogs of native human glucagon. For example, the amino acid modification may be a substitution of the Tyr at position 1 of SEQ ID NO: 2 with an amino acid selected from the group consisting of D-histidine, alpha,alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. Alternatively or additionally, the amino acid modification is a substitution of the Ala at position 2 of SEQ ID NO: 2 with an amino acid selected from the group consisting of D-serine, D-alanine, valine, glycine, N-methyl serine, N-methyl alanine, and aminoisobutyric acid (AIB). In some specific aspects, the GIP agonist peptide which is an analog of native GIP comprises or further comprises a C-terminal extension comprising 1-21 amino acids. Such extensions are known in the art and include those described herein with regard to fusion peptides of glucagon analogs. In specific aspects, the extension comprises the amino acid sequence of any of SEQ ID NOs: 3 to 9. In some embodiments, the Xaa of SEQ ID NO: 4, 6, or 7 is a small, aliphatic residue, e.g., a Gly. In some embodiments, the C-terminal extension comprises 1-6 positive-charged amino acids, e.g., Arg, an analog of Arg, an amino acid of Formula IV, e.g., Lys, d-Lys, Orn, Dab, etc. In some embodiments, GIP agonist peptide is an analog of GIP and comprises an amino acid modification which reduces agonist activity at the GIP receptor to, e.g., a level such that the EC50 at the GIP receptor is within 10-fold of the IC50 of the glucagon antagonist peptide of the peptide combination. Suitable amino acid modifications that reduce GIP agonist activity include, for example, substitution of the Tyr at position 1 with a small aliphatic amino acid residue, e.g., Ala, Gly, or with an imidazole containing amino acid, e.g., His, or an analog thereof. In some aspects, the amino acid modification that reduce GIP agonist activity is a deletion of the amino acid at position 1 or a deletion of the amino acids at positions 1 and 2. Additional modifications of the native GIP amino acid sequence (SEQ ID NO: 2), such as any of those taught herein in the context of a GIP agonist peptide which is an analog of native glucagon, e.g., any of those taught as affecting activity at the GIP receptor, GLP-1 receptor, and/or glucagon receptor, increasing stability, solubility, half-life, time of action, and the like, are contemplated.

Analogs of Native Human Glucagon

In some embodiments, the GIP agonist peptide is structurally similar to native human glucagon (SEQ ID NO: 1), e.g., is an analog of native human glucagon (or "glucagon analog"). Such analogs of glucagon exhibiting GIP receptor agonist activity are known in the art. See, for example, the teachings of International Patent Application No. PCT US2009/47447 (filed on Jun. 16, 2009), U.S. Application No. 61/073,274 (filed Jun. 17, 2008); U.S. Application No. 61/078,171 (filed Jul. 3, 2008); U.S. Application No. 61/090,448 (filed Aug. 20, 2008), U.S. Application No. 61/151,349 (filed Feb. 10, 2009), and U.S. Application No. 61/187,578; the contents of which are incorporated by reference in their entirety.

In some embodiments, the GIP agonist peptide is an analog of native human glucagon (SEQ ID NO: 1) which comprises an amino acid sequence based on the amino acid sequence of SEQ ID NO: 1 but is modified with 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.), amino acid modifications. In some embodiments, the GIP agonist peptide comprises a total of 1, up to 2, up to 3, up to 4, up to 5, up to 6, up to 7, up to 8, up to 9, or up to 10 amino acid modifications relative to the native human glucagon sequence (SEQ ID NO: 1). In some embodiments, the modifications are any of those described herein, e.g., acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29.

In some embodiments, the GIP agonist peptide of the present disclosures comprises an amino acid sequence which has at least 25% sequence identity to the amino acid sequence of native human glucagon (SEQ ID NO: 1). In some embodiments, the GIP agonist peptide comprises an amino acid sequence which is at least 30%, at least 40%, at least 50%, at least 60%, at least 70%, at least 80%, at least 85%, at least 90% or has greater than 90% sequence identity to SEQ ID NO: 1. In some embodiments, the amino acid sequence of the GIP agonist peptide which has the above-referenced % sequence identity is the full-length amino acid sequence of the GIP agonist peptide. In some embodiments, the amino acid sequence of the GIP agonist peptide which has the above-referenced % sequence identity is only a portion of the amino acid sequence of the GIP agonist peptide. In some embodiments, the GIP agonist peptide comprises an amino acid sequence which has about A % or greater sequence identity to a reference amino acid sequence of at least 5 contiguous amino acids (e.g., at least 6, at least 7, at least 8, at least 9, at least 10 amino acids) of SEQ ID NO: 1, wherein the reference amino acid sequence begins with the amino acid at position C of SEQ ID NO: 1 and ends with the amino acid at position D of SEQ ID NO: 1, wherein A is 25, 30, 35, 40, 45, 50, 55, 60, 65, 70, 75, 80, 85, 90, 91, 92, 93, 94, 95, 96, 97, 98, 99; C is 1, 2, 3, 4, 5, 6, 7, 8, 9, 10, 11, 12, 13, 14, 15, 16, 17, 18, 19, 20, 21, 22, 23, 24, 25, 26, 27, or 28 and D is 5, 6, 7, 8, 9, 10, 11, 12, 13, 14, 15, 16, 17, 18, 19, 20, 21, 22, 23, 24, 25, 26, 27, 28 or 29. Any and all possible combinations of the foregoing parameters are envisioned, including but not limited to, e.g., wherein A is 90% and C and D are 1 and 27, or 6 and 27, or 8 and 27, or and 27, or 12 and 27, or 16 and 27.

The GIP agonist peptides which are analogs of native human glucagon (SEQ ID NO: 1) described herein may comprise a peptide backbone of any number of amino acids, i.e., can be of any peptide length. In some embodiments, the GIP agonist peptides described herein are the same length as SEQ ID NO: 1, i.e., are 29 amino acids in length. In some embodiments, the GIP agonist peptide is longer than 29 amino acids in length, e.g., the GIP agonist peptide comprises a C-terminal extension of 1-21 amino acids, as further described herein. Accordingly, the GIP agonist peptide in some embodiments, is 30, 31, 32, 33, 34, 35, 36, 37, 38, 39, 40, 41, 42, 43, 44, 45, 46, 47, 48, 49, or 50 amino acids in length. In some embodiments, the GIP agonist peptide is up to 50 amino acids in length. In some embodiments, the GIP agonist peptide is longer than 29 amino acids in length (e.g., greater than 50 amino acids, (e.g., at least or about 60, at least or about 70, at least or about 80, at least or about 90, at least or about 100, at least or about 150, at least or about 200, at least or about 250, at least or about 300, at least or about 350, at least or about 400, at least or about 450, at least or about 500 amino acids in length) due to fusion with another peptide. In other embodiments, the GIP agonist peptide is less than 29 amino acids in length, e.g., 28, 27, 26, 25, 24, 23, amino acids.

In accordance with the foregoing, in some aspects, the GIP agonist peptide of the present disclosures is an analog of native human glucagon (SEQ ID NO: 1) comprising SEQ ID NO: 1 modified with one or more amino acid modifications which affect GIP activity, glucagon activity, and/or GLP-1 activity, enhance stability, e.g., by reducing degradation of the peptide (e.g., by improving resistance to DPP-IV proteases), enhance solubility, increase half-life, delay the onset of action, extend the duration of action at the GIP, glucagon, or GLP-1 receptor, or a combination of any of the foregoing. Such amino acid modifications, in addition to other modifications, are further described herein.

Exemplary Embodiments of the GIP Agonist Peptides which are Glucagon Analogs

In accordance with some embodiments of the present disclosures, the GIP agonist peptide which is an analog of glucagon (SEQ ID NO: 1) comprises SEQ ID NO: 1 with (a) an amino acid modification at position 1 that confers GIP agonist activity, (b) a modification which stabilizes the alpha helix structure of the C-terminal portion (amino acids 12-29) of the GIP agonist peptide, and (c) optionally, 1 to 10 (e.g., 1, 2, 3, 4, 5, 6, 7, 8, 9, 10) further amino acid modifications. In some embodiments, the analog exhibits at least or about 0.1% (e.g., at least or about 0.25%, at least or about 0.5%, at least or about 0.75%, at least or about 1%) activity of native GIP at the GIP receptor or any other activity level at the GIP receptor described herein.

In certain embodiments, the modification which stabilizes the alpha helix structure is one which provides or introduces an intramolecular bridge, including, for example, a covalent intramolecular bridge, such as any of those described herein. The covalent intramolecular bridge in some embodiments is a lactam bridge. The lactam bridge of the GIP agonist peptide of these embodiments can be a lactam bridge as described herein. See, e.g., the teachings of lactam bridges under the section "Stabilization of the Alpha Helix Structure." For example, the lactam bridge may be one which is between the side chains of amino acids at positions i and i+4 or between the side chains of amino acids at positions j and j+3, wherein i is 12, 13, 16, 17, 20 or 24, and wherein j is 17. In certain embodiments, the lactam bridge can be between the amino acids at positions 16 and 20, wherein one of the amino acids at positions 16 and 20 is substituted with Glu and the other of the amino acids at positions 16 and 20 is substituted with Lys.

In alternative embodiments, the modification which stabilizes the alpha helix structure is the introduction of one, two, three, or four $\alpha,\alpha$-disubstituted amino acids at position(s) 16, 20, 21, and 24 of the GIP agonist peptide. In some embodiments, the $\alpha,\alpha$-disubstituted amino acid is AIB. In certain aspects, the $\alpha,\alpha$-disubstituted amino acid (e.g., AIB) is at position 20 and the amino acid at position 16 is substituted with a positive-charged amino acid, such as, for example, an amino acid of Formula IV, which is described herein. The amino acid of Formula IV may be homoLys, Lys, Orn, or 2,4-diaminobutyric acid (Dab).

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

In certain aspects in which the GIP agonist peptide comprises an amino acid modification at position 1 that confers GIP agonist activity and a modification which stabilizes the alpha helix structure of the C-terminal portion (amino acids 12-29) of the GIP agonist peptide, the GIP agonist peptide further comprises amino acid modifications at one, two or all of positions 27, 28 and 29. In some aspects, the Met at position 27 is substituted with a large aliphatic amino acid, optionally Leu, the Asn at position 28 is substituted with a small aliphatic amino acid, optionally Ala, the Thr at position 29 is substituted with a small aliphatic amino acid, optionally Gly, or a combination of two or three of the foregoing. In specific embodiments, the GIP agonist peptide which is a glucagon analog comprises Leu at position 27, Ala at position 28, and Gly or Thr at position 29.

In certain embodiments of the present disclosures in which the GIP agonist peptide comprises an amino acid modification at position 1 that confers GIP agonist activity and a modification which stabilizes the alpha helix structure of the C-terminal portion (amino acids 12-29) of the GIP agonist peptide, the GIP agonist peptide further comprises an extension of 1 to 21 amino acids C-terminal to the amino acid at position 29. The extension in some aspects comprises the amino acid sequence of SEQ ID NO: 3 or 4, for instance. Additionally or alternatively, the GIP agonist peptide in some aspects comprises an extension of which 1-6 amino acids of the extension are positive-charged amino acids. The positive-charged amino acids in some embodiments are amino acids of Formula IV, including, but not limited to Lys, d-Lys, homoLys, Orn, and Dab. In some embodiments, the positive-charged amino acid is Arg, or an analog thereof. In some aspects, the extension comprises 1-6 aa that are negative-charged amino acids, e.g., Asp, Glu.

In some embodiments in which the GIP agonist peptide comprises an amino acid modification at position 1 that confers GIP agonist activity and a modification which stabilizes the alpha helix structure of the C-terminal portion (amino acids 12-29) of the GIP agonist peptide, the GIP agonist peptide is acylated or alkylated as described herein. In some aspects, the acyl or alkyl group is attached to the GIP agonist peptide, with or without a spacer, at position 10 or 40 of the GIP agonist peptide, as further described herein. The GIP agonist peptide in addition or alternative aspects is modified to comprise a hydrophilic moiety as further described herein. Furthermore, in some embodiments, the GIP agonist peptide comprises any one or a combination of the following modifications:

(a) Ser at position 2 substituted with D-Ser, Ala, D-Ala, Gly, N-methyl-Ser, AIB, Val, or α-amino-N-butyric acid;
(b) Tyr at position 10 substituted with Trp, Lys, Orn, Glu, Phe, or Val:
(c) Linkage of an acyl group to a Lys at position 10;
(d) Lys at position 12 substituted with Arg or Ile;
(e) Ser at position 16 substituted with Glu, Gln, homoglutamic acid, homocysteic acid, Thr, Gly, or AIB;
(f) Arg at position 17 substituted with Gln;
(g) Arg at position 18 substituted with Ala, Ser, Thr, or Gly;
(h) Gln at position 20 substituted with Ser, Thr, Ala, Lys, Citrulline, Arg, Orn, or AIB;
(i) Asp at position 21 substituted with Glu, homoglutamic acid, homocysteic acid;
(j) Val at position 23 substituted with Ile;
(k) Gln at position 24 substituted with Asn, Ser, Thr, Ala, or AIB;
(l) and a conservative substitution at any of positions 2 5, 9, 10, 11, 12, 13, 14, 15, 16, 8 19 20, 21, 24, 27, 28, and 29.

In exemplary embodiments, the GIP agonist peptide which is an analog of glucagon (SEQ ID NO: 1) comprises the following modifications:
(a) an amino acid modification at position 1 that confers GIP agonist activity,
(b) a lactam bridge between the side chains of amino acids at positions i and i+4 or between the side chains of amino acids at positions j and j+3, wherein i is 12, 13, 16, 17, 20 or 24, and wherein j is 17,
(c) amino acid modifications at one, two or all of positions 27, 28 and 29, e.g., amino acid modifications at position 27 and/or 28, and
(d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The lactam bridge of the GIP agonist peptide of these embodiments can be a lactam bridge as described herein. See, e.g., the teachings of lactam bridges under the section "Stabilization of the Alpha Helix Structure." For example, the lactam bridge can be between the amino acids at positions 16 and 20, wherein one of the amino acids at positions 16 and 20 is substituted with Glu and the other of the amino acids at positions 16 and 20 is substituted with Lys.

In accordance with these embodiments, the analog can comprise, for example, the amino acid sequence of any of SEQ ID NOs: 105-194. In some aspects, the GIP agonist peptide comprises a modified amino acid sequence of SEQ ID NOs: 105-194. in which the amino acid at position 1 is substituted with Ala or is deleted.

In other exemplary embodiments, the GIP agonist peptide which is an analog of glucagon (SEQ ID NO: 1) and which exhibits GIP agonist activity comprises the following modifications:
(a) an amino acid modification at position 1 that confers GIP agonist activity,
(b) one, two, three, or all of the amino acids at positions 16, 20, 21, and 24 of the analog is substituted with an α,α-disubstituted amino acid,
(c) amino acid modifications at one, two or all of positions 27, 28 and 29, e.g., amino acid modifications at position 27 and/or 28, and
(d) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The α,α-disubstituted amino acid of the GIP agonist peptide of these embodiments can be any α,α-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the α,α-disubstituted amino acid is AIB. In certain embodiments, the amino acid at position 20 is substituted with an α,α-disubstituted amino acid, e.g., AIB.

In accordance with these embodiments, the analog can comprise, for example, the amino acid sequence of any of SEQ ID NOs: 199-241, 244-264, 266-269, and 273-278. In some aspects, the GIP agonist peptide comprises a modified amino acid sequence of SEQ ID NOs: 199-241, 244-264, 266-269, and 273-278 in which the amino acid at position 1 is substituted with Ala or is deleted.

In yet other exemplary embodiments, the GIP agonist peptide which is an analog of glucagon (SEQ ID NO: 1) comprises the following modifications:
(a) an amino acid modification at position 1 that confers GIP agonist activity,
(b) an amino acid substitution of Ser at position 16 with an amino acid of Formula IV:

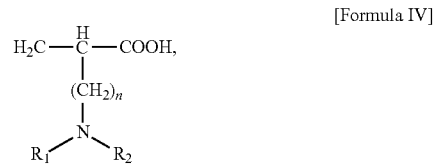

[Formula IV]

wherein n is 1 to 16, or 1 to 10, or 1 to 7, or 1 to 6, or 2 to 6, each of R1 and R2 is independently selected from the group consisting of H, C1-C18 alkyl, (C1-C18 alkyl)OH, (C1-C18 alkyl)NH2, (C1-C18 alkyl)SH, (C0-C4 alkyl)(C3-C6)cycloalkyl, (C0-C4 alkyl)(C2-C5 heterocyclic), (C0-C4 alkyl)(C6-C10 aryl)R7, and (C1-C4 alkyl)(C3-C9 heteroaryl), wherein R7 is H or OH, and the side chain of the amino acid of Formula IV comprises a free amino group,
(c) an amino acid substitution of the Gln at position 20 with an alpha, alpha-disubstituted amino acid,
(d) amino acid modifications at one, two or all of positions 27, 28 and 29, e.g., amino acid modifications at position 27 and/or 28, and
(e) 1-9 or 1-6 further amino acid modifications, e.g. 1, 2, 3, 4, 5, 6, 7, 8 or 9 further amino acid modifications, and the EC50 of the analog for GIP receptor activation is about 10 nM or less.

The amino acid of Formula IV of the analog of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

The alpha,alpha-disubstituted amino acid of the GIP agonist peptide of these embodiments may be any alpha, alpha-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha,alpha-disubstituted amino acid is AIB.

In accordance with these embodiments, the analog can comprise, for example, the amino acid sequence of any of SEQ ID NOs: 199-265. In some aspects, the GIP agonist peptide comprises a modified amino acid sequence of SEQ ID NOs: 199-265 in which the amino acid at position 1 is substituted with Ala or is deleted.

In yet other exemplary embodiments, the GIP agonist peptide which is an analog of glucagon (SEQ ID NO: 1) comprises:
(a) an amino acid modification at position 1 that confers GIP agonist activity, and
(b) an extension of about 1 to about 21 amino acids C-terminal to the amino acid at position 29, wherein at least one of the amino acids of the extension is acylated or alkylated,
wherein the EC50 of the analog for GIP receptor activation is about 10 nM or less.

In some embodiments, the acylated or alkylated amino acid is an amino acid of Formula I, II, or III. In more specific embodiments, the amino acid of Formula I is Dab, Orn, Lys, or homoLys. Also, in some embodiments, the extension of about 1 to about 21 amino acids comprises the amino acid sequence of GPSSGAPPPS (SEQ ID NO: 3) or XGPSS-GAPPPS (SEQ ID NO: 4), wherein X is any amino acid, or GPSSGAPPPK (SEQ ID NO: 5) or XGPSSGAPPPK (SEQ ID NO: 6) or XGPSSGAPPPSK (SEQ ID NO: 7), wherein X is Gly or a small, aliphatic or non-polar or slightly polar amino acid. In some embodiments, the about 1 to about 21 amino acids may comprise sequences containing one or more conservative substitutions relative to SEQ ID NOs: 3, 4, 5, 6, or 7. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In some embodiments, the GIP agonist peptide which is an analog of glucagon (SEQ ID NO: 1) further comprises amino acid modifications at one, two or all of positions 27, 28 and 29, e.g., amino acid modifications at position 27 and/or 28.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the analog can comprise such amino acid modifications at position 27 and/or 28.

The GIP agonist peptide of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The analog can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 3) or XGPSSGAPPPS (SEQ ID NO: 4), or sequences containing one or more conservative substitutions relative to SEQ ID NO: 3 or 4, to the C-terminus. Accordingly, the GIP agonist peptide which is an analog of glucagon (SEQ ID NO: 1) in some aspects comprises one or more of the following modifications:
(a) Ser at position 2 substituted with D-Ser, Ala, D-Ala, Gly, N-methyl-Ser, AIB, Val, or α-amino-N-butyric acid;
(b) Tyr at position 10 substituted with Trp, Lys, Orn, Glu, Phe, or Val;
(c) Linkage of an acyl group to a Lys at position 10;
(d) Lys at position 12 substituted with Arg;
(e) Ser at position 16 substituted with Glu, Gln, homoglutamic acid, homocysteic acid, Thr, Gly, or AIB;
(f) Arg at position 17 substituted with Gln;
(g) Arg at position 18 substituted with Ala, Ser, Thr, or Gly;
(h) Gln at position 20 substituted with Ala, Ser, Thr, Lys, Citrulline, Arg, Orn, or AIB;
(i) Asp at position 21 substituted with Glu, homoglutamic acid, homocysteic acid;
(j) Val at position 23 substituted with Ile;
(k) Gln at position 24 substituted with Asn, Ala, Ser, Thr, or AIB; and
(l) a conservative substitution at any of positions 2, 5, 9, 10, 11, 12, 13, 14, 15, 16, 17, 18, 19, 20, 21, 24, 27, 28, and 29.

The GIP agonist peptide in some embodiments comprises a combination of the modifications (a) through (l). Alternatively or additionally, the GIP agonist peptide can comprise an amino acid modification at position 3 of SEQ ID NO: 1 (e.g., an amino acid substitution of Gln with Glu), wherein the GIP agonist peptide has less than 1% of the activity of glucagon at the glucagon receptor. Alternatively or additionally, the GIP agonist peptide can comprise an amino acid modification at position 7 of SEQ ID NO: 1 (e.g., an amino acid substitution of Thr with an amino acid lacking a hydroxyl group, e.g., Abu or Ile), wherein the GIP agonist peptide has less than about 10% of the activity of GLP-1 at the GLP-1 receptor.

With regard to the exemplary embodiments, the GIP agonist peptide which is an analog of glucagon (SEQ ID NO: 1) can be covalently linked to a hydrophilic moiety. In some embodiments, the GIP agonist peptide is covalently linked to the hydrophilic moiety at any of amino acid positions 16, 17, 20, 21, 24, 29, 40, or the C-terminus. In certain embodiments, the GIP agonist peptide comprises a C-terminal extension (e.g., an amino acid sequence of SEQ ID NO: 3) and an addition of an amino acid comprising the hydrophilic moiety, such that the hydrophilic moiety is covalently linked to the GIP agonist peptide at position 40.

In some embodiments, the hydrophilic moiety is covalently linked to a Lys, Cys, Orn, homocysteine, or acetyl-phenylalanine of the GIP agonist peptide. The Lys, Cys, Orn, homocysteine, or acetyl-phenylalanine may be an amino acid that is native to the glucagon sequence (SEQ ID NO: 1) or it may be an amino acid which is replacing a native amino acid of SEQ ID NO: 1. In some embodiments, wherein the hydrophilic moiety is attached to a Cys, the linkage to the hydrophilic moiety can comprise the structure

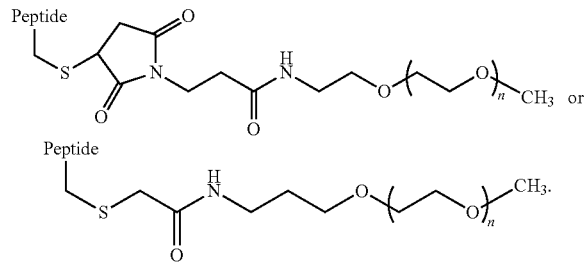

With regard to the GIP agonist peptides comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

With regard to any of the above exemplary embodiments, the GIP agonist peptide which is an analog of glucagon (SEQ ID NO: 1) and which exhibits GIP agonist activity in some embodiments comprises a modified amino acid in which the side chain is covalently linked to an acyl or alkyl group (e.g., an acyl or alkyl group which is non-native to a naturally-occurring amino acid). The acylated or alkylated analog can be in accordance with acylated or alkylated peptides described in the section "Acylation and alkylation." In some embodiments, the acyl group is a C4 to a C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group. The acyl or alkyl group may be covalently attached to any amino acid of the analog, including, but not limited to the amino acid at position 10 or 40, or the C-terminal amino acid. In certain embodiments, the analog comprises a C-terminal extension (e.g., an amino acid sequence of SEQ ID NO: 3) and an addition of an amino acid comprising the acyl or alkyl group, such that the acyl or alkyl group is covalently linked to the analog at position 40. In some embodiments, the acyl or alkyl group is covalently linked to the side chain of an amino acid of Formula I, II, or III, e.g., a Lys residue. The acyl or alkyl group may be covalently linked to an amino acid which is native to the glucagon sequence (SEQ ID NO: 1) or may be linked to an amino acid which is added to the sequence of SEQ ID NO: 1 or to the sequence of SEQ ID NO: 1 followed by SEQ ID NO: 3 (at the N- or C-terminus) or may be linked to an amino acid which replaces a native amino acid, e.g., the Tyr at position 10 of SEQ ID NO: 1.

In the above exemplary embodiments, wherein the GIP agonist peptide comprises an acyl or alkyl group, the GIP agonist peptide may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms.

In still further exemplary embodiments, the GIP agonist peptide which is an analog of glucagon (SEQ ID NO: 1) comprises the amino acid sequence according to any one of SEQ ID NOs: 327, 328, 329, or 330 that further comprises the following modifications:
(a) optionally, an amino acid modification at position 1 that confers GIP agonist activity,
(b) an extension of about 1 to about 21 amino acids C-terminal to the amino acid at position 29, wherein at least one of the amino acids of the extension is acylated or alkylated, and
(d) up to 6 further amino acid modifications,
wherein the EC50 of the analog for GIP receptor activation is about 10 nM or less.

In some aspects, the GIP agonist peptide comprises SEQ ID NOs: 327-330 in which the amino acid at position 1 is substituted with Ala or is deleted.

In some aspects, the acylated or alkylated amino acid is an amino acid of Formula I, II, or III. In more specific embodiments, the amino acid of Formula I is Dab, Orn, Lys, or homoLys. Also, in some embodiments, the about 1 to about 21 amino acids comprises the amino acid sequence of GPSSGAPPPS (SEQ ID NO: 3) or XGPSSGAPPPS (SEQ ID NO: 4), wherein X is any amino acid, or GPSSGAPPPK (SEQ ID NO: 5) or XGPSSGAPPPK (SEQ ID NO: 6) or XGPSSGAPPPSK (SEQ ID NO: 7), wherein X is Gly or a small, aliphatic or non-polar or slightly polar amino acid. In some embodiments, the about 1 to about 21 amino acids may comprise sequences containing one or more conservative substitutions relative to SEQ ID NO: 3, 4, 5, 6, or 7. In some embodiments, the acylated or alkylated amino acid is located at position 37, 38, 39, 40, 41, 42, or 43 of the C-terminally-extended analog. In certain embodiments, the acylated or alkylated amino acid is located at position 40 of the C-terminally extended analog.

In any of the above exemplary embodiments, the amino acid at position 1 that confers GIP agonist activity can be an amino acid lacking an imidazole side chain. The amino acid at position 1 can, for example, be a large, aromatic amino acid. In some embodiments, the large, aromatic amino acid is any of those described herein, including, for example, Tyr.

The GIP agonist peptide of the above exemplary embodiments can further comprise 1-6 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability.

In certain aspects, GIP agonist peptides described in the above exemplary embodiment, comprise further amino acid modifications at one, two or all of positions 27, 28 and 29. Modifications at these positions can be any of the modifications described herein relative to these positions. For example, relative to SEQ ID NOs: 327, 328, 329, or 330, position 27 can be substituted with a large aliphatic amino acid (e.g., Leu, Ile or norleucine) or Met, position 28 can be substituted with another small aliphatic amino acid (e.g., Gly or Ala) or Asn, and/or position 29 can be substituted with another small aliphatic amino acid (e.g., Ala or Gly) or Thr. Alternatively, the analog can comprise such amino acid modifications at position 27 and/or 28.

The analog can further comprise one or more of the following additional modifications:
(a) the amino acid at position 2 is any one of D-Ser, Ala, D-Ala, Gly, N-methyl-Ser, AIB, Val, or α-amino-N-butyric acid;

(b) the amino acid at position 10 is Tyr, Trp, Lys, Orn, Glu, Phe, or Val;
(c) linkage of an acyl group to a Lys at position 10;
(d) the amino acid at position 12 is Ile, Lys or Arg;
(e) the amino acid at position 16 is any one of Ser, Glu, Gln, homoglutamic acid, homocysteic acid, Thr, Gly, or AIB;
(f) the amino acid at position 17 is Gln or Arg;
(g) the amino acid at position 18 is any one of Ala, Arg, Ser, Thr, or Gly;
(h) the amino acid at position 20 is any one of Ala, Ser, Thr, Lys, Citrulline, Arg, Orn, or AIB or another alpha,alpha-disubstituted amino acid;
(i) the amino acid at position 21 is any one of Glu, Asp, homoglutamic acid, homocysteic acid;
(j) the amino acid at position 23 is Val or Ile;
(k) the amino acid at position 24 is any one of Gln, Asn, Ala, Ser, Thr, or AIB; and
(l) one or more conservative substitutions at any of positions 2, 5, 9, 10, 11, 12, 13, 14, 15, 16, 17, 18, 19, 20, 21, 24, 27, 28, and 29.

The GIP agonist peptide in some embodiments comprises a combination of the modifications (a) through (l). Alternatively or additionally, the GIP agonist peptide can comprise an amino acid modification at position 3 of SEQ ID NO: 1 (e.g., an amino acid substitution of Gln with Glu), wherein the GIP agonist peptide has less than 1% of the activity of glucagon at the glucagon receptor. Alternatively or additionally, the GIP agonist peptide can comprise an amino acid modification at position 7 of SEQ ID NO: 1 (e.g., an amino acid substitution of Thr with an amino acid lacking a hydroxyl group, e.g., Abu or Ile), wherein the GIP agonist peptide has less than about 10% of the activity of GLP-1 at the GLP-1 receptor.

With regard to the exemplary embodiments, the analog can be covalently linked to a hydrophilic moiety. In some embodiments, the analog is covalently linked to the hydrophilic moiety at any of amino acid positions 16, 17, 20, 21, 24, 29, 40, or the C-terminus. In certain embodiments, the analog comprises a hydrophilic moiety covalently linked to the analog at position 24.

In some embodiments, the hydrophilic moiety is covalently linked to a Lys, Cys, Orn, homocysteine, or acetyl-phenylalanine of the analog. The Lys, Cys, Orn, homocysteine, or acetyl-phenylalanine may be an amino acid that is native to SEQ ID NO: 1, 227, 228, 229 or 230 of Sequence Listing 2, or it may be a substituted amino acid. In some embodiments, wherein the hydrophilic moiety is linked to a Cys, the linkage may comprise the structure

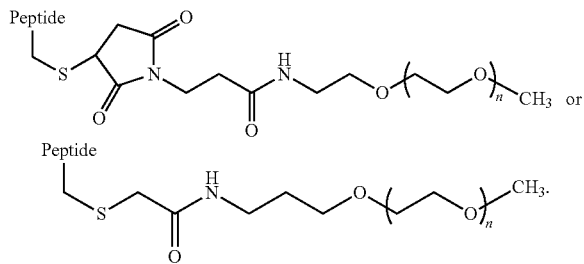

With regard to the GIP agonist peptides comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

With regard to the exemplary embodiments, the GIP agonist peptide can comprise a modified amino acid within the C-terminal extension in which the side chain is covalently linked to an acyl or alkyl group. The acylated or alkylated analog can be in accordance with acylated or alkylated peptides described in the section "Acylation and alkylation." In some embodiments, the acyl group is a C4 to a C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group. The acyl or alkyl group may be covalently attached to any amino acid of the analog, including, but not limited to the amino acid at position 10 or 40, or the C-terminal amino acid. In some embodiments, the acyl or alkyl group is covalently linked to the side chain of an amino acid of Formula I, II, or III, e.g., a Lys residue. The acyl or alkyl group is covalently linked to an amino acid which is native to SEQ ID NO: 1, 327, 328, 329, or 330 or it may be linked to a substituted amino acid. The acyl or alkyl group is covalently linked to an amino acid which is native to SEQ ID NO: 3, 4, 6 or 7, or it may be linked to a substituted amino acid.

In the above exemplary embodiments, wherein the GIP agonist peptide comprises an acyl or alkyl group, the GIP agonist peptide may be attached to the acyl or alkyl group via a spacer, as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms.

In some very specific embodiments, an GIP agonist peptide of the present disclosures comprises an amino acid sequence selected from the group consisting of SEQ ID NOs: 199-241, 244-264, 266, 292-307, 309-321 and 323 or selected from the group consisting of SEQ ID NOs: 267-269, 273-278, and 325. In some aspects, the GIP agonist peptide comprises a modified amino acid sequence of any of SEQ ID NOs: 199-241, 244-264, 266, 292-307, 309-321, and 323 or any of SEQ ID NOs: 267-269, 273-278, and 325, in which the amino acid at position 1 is substituted with Ala or is deleted.

Further, specific examples of GIP agonist peptides of the present disclosures include but are not limited to, any of SEQ ID NOs: 105-194, 199-246, 248-250, and 253-278.

In still further exemplary embodiments, the GIP agonist peptide which is an analog of glucagon (SEQ ID NO: 1) comprises an acyl or alkyl group (e.g., an acyl or alkyl group which is non-native to a naturally occurring amino acid), wherein the acyl or alkyl group is attached to a spacer, wherein (i) the spacer is attached to the side chain of the amino acid at position 10 of the analog; or (ii) the analog comprises an extension of 1 to 21 amino acids C-terminal to the amino acid at position 29 and the spacer is attached to the side chain of an amino acid corresponding to one of positions 37-43 relative to SEQ ID NO: 1, wherein the EC50 of the analog for GIP receptor activation is about 10 nM or less.

In such embodiments, the GIP agonist peptide may comprise an amino acid sequence of SEQ ID NO: 1 with (i) an amino acid modification at position 1 that confers GIP agonist activity, (ii) amino acid modifications at one, two, or all of positions 27, 28, and 29, (iii) at least one of:

(A) the analog comprises a lactam bridge between the side chains of amino acids at positions i and i+4 or between the side chains of amino acids at positions j and j+3, wherein i is 12, 13, 16, 17, 20 or 24, and wherein j is 17;

(B) one, two, three, or all of the amino acids at positions 16, 20, 21, and 24 of the analog is substituted with an α,α-disubstituted amino acid; or (C) the analog comprises (i) an amino acid substitution of Ser at position 16 with an amino acid of Formula IV:

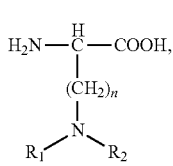

[Formula IV]

wherein n is 1 to 7, wherein each of R1 and R2 is independently selected from the group consisting of H, C1-C18 alkyl, (C1-C18 alkyl)OH, (C1-C18 alkyl)NH2, (C1-C18 alkyl)SH, (C0-C4 alkyl)(C3-C6)cycloalkyl, (C0-C4 alkyl)(C2-C5 heterocyclic), (C0-C4 alkyl)(C6-C10 aryl)R7, and (C1-C4 alkyl)(C3-C9 heteroaryl), wherein R7 is H or OH, and the side chain of the amino acid of Formula IV comprises a free amino group; and (ii) an amino acid substitution of the Gln at position 20 with an alpha,alpha-disubstituted amino acid, and (iii) up to 6 further amino acid modifications.

The alpha,alpha-disubstituted amino acid of the GIP agonist peptide of these embodiments may be any alpha, alpha-disubstituted amino acid, including, but not limited to, amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In certain embodiments, the alpha,alpha-disubstituted amino acid is AIB.

The amino acid of Formula IV of the GIP agonist peptide of these embodiments may be any amino acid, such as, for example, the amino acid of Formula IV, wherein n is 1, 2, 3, 4, 5, 6, 7, 8, 9, 10, 11, 12, 13, 14, 15, or 16. In certain embodiments, n is 2, 3, 4, or 5, in which case, the amino acid is Dab, Orn, Lys, or homoLys respectively.

In any of the above exemplary embodiments, the amino acid modification at position 1 that confers GIP agonist activity can be a substitution of His with an amino acid lacking an imidazole side chain. The amino acid modification at position 1 can, for example, be a substitution of His with a large, aromatic amino acid. In some embodiments, the large, aromatic amino acid is any of those described herein, including, for example, Tyr.

Also, with regard to the above exemplary embodiments, amino acid modifications at one, two, or all of positions 27, 28, and 29 can be any of the modifications at these positions described herein. For example, the Met at position 27 can be substituted with a large aliphatic amino acid, optionally Leu, the Asn at position 28 can be substituted with a small aliphatic amino acid, optionally Ala, and/or the Thr at position 29 can be substituted with a small aliphatic amino acid, optionally Gly. Alternatively, the GIP agonist peptide can comprise such amino acid modifications at position 27 and/or 28.

The GIP agonist peptide of the above exemplary embodiments can further comprise 1-9 or 1-6 further, additional amino acid modifications, e.g. 1, 2, 3, 4, 5, 6, 7, 8 or 9 further amino acid modifications, such as, for example, any of the modifications described herein which increase or decrease the activity at any of the GIP, GLP-1, and glucagon receptors, improve solubility, improve duration of action or half-life in circulation, delay the onset of action, or increase stability. The GIP agonist peptide can further comprise, for example, an amino acid modification at position 12, optionally, a substitution with Ile, and/or amino acid modifications at positions 17 and 18, optionally substitution with Q at position 17 and A at position 18, and/or an addition of GPSSGAPPPS (SEQ ID NO: 3) or XGPSSGAPPPS (SEQ ID NO: 4), or sequences containing one or more conservative substitutions relative to SEQ ID NO: 3 or 4, to the C-terminus. Accordingly, in some aspects, the GIP agonist peptide which is an analog of glucagon (SEQ ID NO: 1) comprises one or more of the following modifications:

(a) Ser at position 2 substituted with D-Ser, Ala, D-Ala, Gly, N-methyl-Ser, AIB, Val, or α-amino-N-butyric acid;

(b) Tyr at position 10 substituted with Trp, Lys, Orn, Glu, Phe, or Val;

(c) Linkage of an acyl group to a Lys at position 10;

(d) Lys at position 12 substituted with Arg;

(e) Ser at position 16 substituted with Glu, Gln, homoglutamic acid, homocysteic acid, Thr, Gly, Lys, or AIB;

(f) Arg at position 17 substituted with Gln;

(g) Arg at position 18 substituted with Ala, Ser, Thr, or Gly;

(h) Gln at position 20 substituted with Ala, Ser, Thr, Lys, Citrulline, Arg, Orn, or AIB;

(i) Asp at position 21 substituted with Glu, homoglutamic acid, homocysteic acid;

(j) Val at position 23 substituted with Ile;

(k) Gln at position 24 substituted with Asn, Ala, Ser, Thr, or AIB; and (l) a conservative substitution at any of positions 2, 5, 9, 10, 11, 12, 13, 14, 15, 16, 17, 18, 19, 20, 21, 24, 27, 28, and 29.

The GIP agonist peptide in some embodiments comprise a combination of the modifications (a) through (l). Alternatively or additionally, the GIP agonist peptide can comprise an amino acid modification at position 3 of SEQ ID NO: 1 (e.g., an amino acid substitution of Gln with Glu), wherein the GIP agonist peptide has less than 1% of the activity of glucagon at the glucagon receptor. Alternatively or additionally, the GIP agonist peptide can comprise an amino acid modification at position 7 of SEQ ID NO: 1 (e.g., an amino acid substitution of Thr with an amino acid lacking a hydroxyl group, e.g., Abu or Ile), a deletion of the amino acid(s) C-terminal to the amino acid at position 27 or 28, yielding a 27- or 28-amino acid peptide, or a combination thereof, wherein the GIP agonist peptide has less than about 10% of the activity of GLP-1 at the GLP-1 receptor.

With regard to the exemplary embodiments, the GIP agonist peptide can be covalently linked to a hydrophilic moiety. In some embodiments, the GIP agonist peptide is covalently linked to the hydrophilic moiety at any of amino acid positions 16, 17, 20, 21, 24, 29, 40, or the C-terminus. In certain embodiments, the GIP agonist peptide comprises a C-terminal extension (e.g., an amino acid sequence of SEQ ID NO: 3) and an addition of an amino acid comprising the hydrophilic moiety, such that the hydrophilic moiety is covalently linked to the GIP agonist peptide at position 40.

In some embodiments, the hydrophilic moiety is covalently linked to a Lys, Cys, Orn, homocysteine, or acetyl-phenylalanine of the GIP agonist peptide. The Lys, Cys, Orn, homocysteine, or acetyl-phenylalanine may be an amino acid that is native to the glucagon sequence (SEQ ID NO: 1) or it may be an amino acid which is replacing a native amino acid of SEQ ID NO: 1. In some embodiments, wherein the hydrophilic moiety is attached to a Cys, the linkage to the hydrophilic moiety can comprise the structure

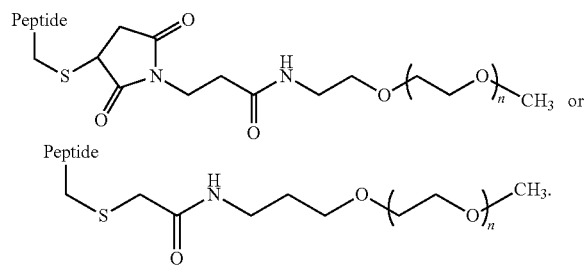

With regard to the GIP agonist peptides comprising a hydrophilic moiety, the hydrophilic moiety may be any of those described herein. See, e.g., the teachings under the section "Linkage of hydrophilic moieties." In some embodiments, the hydrophilic moiety is a polyethylene glycol (PEG). The PEG in certain embodiments has a molecular weight of about 1,000 Daltons to about 40,000 Daltons, e.g., about 20,000 Daltons to about 40,000 Daltons.

In the exemplary embodiments, wherein the GIP agonist peptide comprises an acyl or alkyl group, which is attached to the analog via a spacer, the spacer can be any spacer as described herein. The spacer, for example, may be 3 to 10 atoms in length and may be, for instance, an amino acid (e.g., 6-amino hexanoic acid, any amino acid described herein), a dipeptide (e.g., Ala-Ala, βAla-βAla, Leu-Leu, Pro-Pro, γGlu-γGlu), a tripeptide, or a hydrophilic or hydrophobic bifunctional spacer. In certain aspects, the total length of the spacer and the acyl or alkyl group is about 14 to about 28 atoms.

The acyl or alkyl group is any acyl or alkyl group as described herein, such as an acyl or alkyl group which is non-native to a naturally occurring amino acid. The acyl or alkyl group in some embodiments is a C4 to C30 fatty acyl group, such as, for example, a C10 fatty acyl or alkyl group, a C12 fatty acyl or alkyl group, a C14 fatty acyl or alkyl group, a C16 fatty acyl or alkyl group, a C18 fatty acyl or alkyl group, a C20 acyl or alkyl group, or a C22 acyl or alkyl group, or a C4 to C30 alkyl group. In specific embodiments, the acyl group is a C12 to C18 fatty acyl group (e.g., a C14 or C16 fatty acyl group).

In some embodiments, the extension of about 1 to about 21 amino acids C-terminal to the amino acid at position 29 of the GIP agonist peptide comprises the amino acid sequence of GPSSGAPPPS (SEQ ID NO: 3) or XGPSSGAPPPS (SEQ ID NO: 4), wherein X is any amino acid, or GPSSGAPPPK (SEQ ID NO: 5) or XGPSSGAPPPK (SEQ ID NO: 6) or XGPSSGAPPPSK (SEQ ID NO: 7), wherein X is Gly or a small, aliphatic or non-polar or slightly polar amino acid. In some embodiments, the about 1 to about 21 amino acids may comprise sequences containing one or more conservative substitutions relative to any of SEQ ID NO: 3, 4, 5, 6, or 7. In some embodiments, the acylated or alkylated amino acid is located at position 37, 38, 39, 40, 41, 42, or 43 of the C-terminally-extended GIP agonist peptide.

In certain embodiments, the acylated or alkylated amino acid is located at position 40 of the C-terminally extended GIP agonist peptide.

In some embodiments, the GIP agonist peptide which is an analog of glucagon (SEQ ID NO: 1) is a peptide comprising the amino acid sequence of any of the amino acid sequences, e.g., SEQ ID NOs: 105-194, optionally with up to 1, 2, 3, 4, or 5 further modifications that retain GIP agonist activity. In certain embodiments, the GIP agonist peptide which is an analog of glucagon (SEQ ID NO: 1) and which exhibits GIP agonist activity comprises the amino acids of any of SEQ ID NOs: 199-362. In some aspects, the GIP agonist peptide comprises a modified amino acid sequence of SEQ ID NO: 199-362 in which the amino acid at position 1 is substituted with Ala or is deleted.

In some embodiments of the present disclosures, the GIP agonist peptide comprises the amino acid sequence of SEQ ID NO: 1 with at least one amino acid modification (optionally, up to 15 amino acid modifications), and an extension of 1 to 21 amino acids C-terminal to the amino acid at position 29 of the GIP agonist peptide. In certain aspects, the GIP agonist peptide comprises at least one amino acid modification and up to 15 amino acid modifications (e.g., 1, 2, 3, 4, 5, 6, 7, 8, 9, 10, 11, 12, 13, 14, 15 amino acid modifications, up to 10 amino acid modifications). In certain embodiments, the GIP agonist peptides comprise at least one amino acid modification at up to 10 amino acid modifications and additional conservative amino acid modifications. Conservative amino acid modifications are described herein.

In some aspects, at least one of the amino acid modifications confers a stabilized alpha helix structure in the C-terminal portion of the GIP agonist peptide. Modifications which achieve a stabilized alpha helix structure are described herein. See, for example, the teachings under the section entitled Stabilization of the alpha helix. In some aspects, the GIP agonist peptide comprises an intramolecular bridge (e.g., a covalent intramolecular bridge, a non-covalent intramolecular bridge) between the side chains of two amino acids of the GIP agonist peptide. In certain aspects, an intramolecular bridge links the side chains of the amino acids at positions i and i+4, wherein i is 12, 13, 16, 17, 20, or 24. In other aspects, an intramolecular bridge connects the side chains of the amino acids at positions j and j+3, wherein j is 17, or at positions k and k+7" wherein k is any integer between 12 and 22. In certain embodiments, the intramolecular bridge is a covalent intramolecular bridge, e.g., a lactam bridge. In specific aspects, the lactam bridge connects the side chains of the amino acids at positions 16 and 20. In particular aspects, one of the amino acids at positions 16 and 20 is a positive-charged amino acid and the other is a negative-charged amino acid. For example, the GIP agonist peptide can comprise a lactam bridge connecting the side chains of a Glu at position 16 and a Lys at position 20. In other aspects, the negative-charged amino acid and the positive-charged amino acid form a salt bridge. In this instance, the intramolecular bridge is a non-covalent intramolecular bridge.

In particular aspects, the amino acid modification which confers a stabilized alpha helix is an insertion or substitution of an amino acid of SEQ ID NO: 1 with an α,α-disubstituted amino acid. Suitable α,α-disubstituted amino acids for purposes of stabilizing the alpha helix are described herein and include, for example, AIB. In some aspects, one, two, three, or more of the amino acids at positions 16, 20, 21, and 24 of SEQ ID NO: 1 are substituted with an α,α-disubstituted amino acid, e.g., AIB. In particular embodiments, the amino acid at position 16 is AIB.

The GIP agonist peptide in some aspects comprises additional modifications, such as any of those described herein. For instance, the amino acid modifications may increase or decrease activity at the GLP-1 receptor or decrease activity at the glucagon receptor. The amino acid modifications may increase stability of the peptide, e.g., increase resistance to DPP-IV protease degradation, stabilize the bond between amino acids 15 and 16. The amino acid modifications may increase the solubility of the peptide and/or alter the time of action of the GIP agonist peptide at any of the GIP, glucagon, and GLP-1 receptors. A combination of any of these types of modifications may be present in the GIP agonist peptides which exhibit agonist activity at the GIP receptor.

Accordingly, in some aspects, the GIP agonist peptide comprises the amino acid sequence of SEQ ID NO: 1 with one or more of: Gln at position 17, Ala at position 18, Glu at position 21, Ile at position 23, and Ala, Asn, or Cys at position 24, or conservative amino acid substitutions thereof. In some aspects, the GIP agonist peptide comprises a C-terminal amide in place of the C-terminal alpha carboxylate. In certain embodiments, the GIP agonist peptide comprises an amino acid substitution at position 1, position 2, or positions 1 and 2, which substitution(s) achieve DPP-IV protease resistance. Suitable amino acid substitutions are described herein. For example, DMIA at position 1 and/or d-Ser or AIB at position 2.

Additionally or alternatively, the GIP agonist peptide may comprise one or a combination of: (a) Ser at position 2 substituted with Ala; (b) Gln at position 3 substituted with Glu or a glutamine GIP agonist peptide; (c) Thr at position 7 substituted with a Ile; (d) Tyr at position 10 substituted with Trp or an amino acid comprising an acyl or alkyl group which is non-native to a naturally-occurring amino acid; (e) Lys at position 12 substituted with Ile; (f) Asp at position 15 substituted with Glu; (g) Ser at position 16 substituted with Glu; (h) Gln at position 20 substituted with Ser, Thr, Ala, AIB; (i) Gln at position 24 substituted with Ser, Thr, Ala, AIB; (j) Met at position 27 substituted with Leu or Nle; (k) Asn at position 29 substituted with a charged amino acid, optionally, Asp or Glu; and (l) Thr at position 29 substituted with Gly or a charged amino acid, optionally, Asp or Glu.

In exemplary aspects, the GIP agonist peptide comprises the amino acid sequence of SEQ ID NO:1 with at least one amino acid modification (optionally, up to 15 amino acid modifications), an extension of 1 to 21 amino acids C-terminal to the amino acid at position 29 of the GIP agonist peptide, and an amino acid modification at position 1 which modification confers GIP agonist activity. In alternative exemplary aspects, the GIP agonist peptide does not comprise an amino acid modification at position 1 which modification confers GIP agonist activity. In some aspects, the amino acid at position 1 is not a large, aromatic amino acid, e.g., Tyr. In some embodiments, the amino acid at position 1 is an amino acid comprising an imidazole ring, e.g., His, analogs of His. In certain embodiments, the GIP agonist peptide is not any of the compounds disclosed in U.S. Patent Application No. 61/151,349. In certain aspects, the GIP agonist peptide comprises the amino acid sequence of any of SEQ ID NOs: 1057-1069. In some aspects, the GIP agonist peptide comprises a modified amino acid sequence of any of the glucagon-based sequences of any of SEQ ID NOs: 402-1056 in which the referenced amino acid sequence is modified to have (if it does not already have) (i) a stabilized alpha helix in the C-terminal portion of the peptide (e.g., amino acids 12-29), e.g., stabilized via an intramolecular bridge (e.g., a lactam bridge, a salt bridge) as described herein or stabilized via incorporation of one or more alpha, alpha disubstituted amino acids, e.g., AIB, at, for example, positions 16, 20, 21, 24 of the peptide; (ii) Leu at position 27, Ala at position 28, and Gly at position 29, or conservative amino acid substitutions thereof; (iii) Ile at position 12, or a conservative amino acid substitution thereof, and optionally, (iv) an amino acid modification at position 1 which confers GIP activity as described herein, e.g., His 1 substituted with a large aromatic amino acid, e.g., Tyr. In some aspects, the alpha,alpha disubstituted amino acid is at position 20 and position 16 is a positive-charged amino acid, e.g., an amino acid of Formula IV, e.g., Lys.

With regard to the GIP agonist peptides which comprise an extension of 1-21 amino acids (e.g., 5-19, 7-15, 9-12 amino acids), the extension of the GIP agonist peptide may comprise any amino acid sequence, provided that the extension is 1 to 21 amino acids. In some aspects, the extension is 7 to 15 amino acids and in other aspects, the extension is 9 to 12 amino acids. In some embodiments, the extension comprises (i) the amino acid sequence of SEQ ID NO: 426 or 1074, (ii) an amino acid sequence which has high sequence identity (e.g., at least 80%, 85%, 90%, 95%, 98%, 99%) with the amino acid sequence of SEQ ID NO: 426 or 1074, or (iii) the amino acid sequence of (i) or (ii) with one or more conservative amino acid modifications.

In some embodiments, at least one of the amino acids of the extension is acylated or alkylated. The amino acid comprising the acyl or alkyl group may be located at any position of extension of the GIP agonist peptide. In certain embodiments, the acylated or alkylated amino acid of the extension is located at one of positions 37, 38, 39, 40, 41, or 42 (according to the numbering of SEQ ID NO: 1) of the GIP agonist peptide. In certain embodiments, the acylated or alkylated amino acid is located at position 40 of the GIP agonist peptide.

In exemplary embodiments, the acyl or alkyl group is an acyl or alkyl group which is non-native to a naturally-occurring amino acid. For example, the acyl or alkyl group may be a C4 to C30 (e.g., C12 to C18) fatty acyl group or C4 to C30 (e.g., C12 to C18) alkyl. The acyl or alkyl group may be any of those discussed herein.

In some embodiments, the acyl or alkyl group is attached directly to the amino acid, e.g., via the side chain of the amino acid. In other embodiments, the acyl or alkyl group is attached to the amino acid via a spacer (e.g., an amino acid, a dipeptide, a tripeptide, a hydrophilic bifunctional spacer, a hydrophobic bifunctional spacer). In certain aspects, the spacer is 3 to 10 atoms in length. In some embodiments, the spacer is an amino acid or dipeptide comprising one or two of 6-aminohexanoic acid, Ala, Pro, Leu, beta-Ala, gamma-Glu (e.g., gamma-Glu-gamma-Glu). In particular aspects, the total length of the spacer is 14 to 28 atoms.

Also, in exemplary embodiments, the amino acid to which the acyl or alkyl group is attached may be any of those described herein, including, for example, an amino acid of Formula I, II, or III. The amino acid which is acylated or alkylated may be a Lys, for example. Suitable amino acids comprising an acyl or alkyl group, as well as suitable acyl groups, alkyl groups, and spacers are described herein. See, for example, the teachings under the sections entitled Acylation and Alkylation.

In other embodiments, 1-6 amino acids (e.g., 1-2, 1-3, 1-4, 1-5 amino acids) of the extension are positive-charged amino acids, e.g., Arg, amino acids of Formula IV, such as, for example, Lys, D-Lys. As used herein, the term "positive-charged amino acid" refers to any amino acid, naturally-occurring or non-naturally occurring, comprising a positive charge on an atom of its side chain at a physiological pH. In certain aspects, the positive-charged amino acids are located at any of positions 37, 38, 39, 40, 41, 42, and 43. In specific embodiments, a positive-charged amino acid is located at position 40.

In other embodiments, 1-6 amino acids (e.g., 1-2, 1-3, 1-4, 1-5 amino acids) of the extension are negative-charged amino acids, e.g., Asp, Glu. As used herein, the term "negative-charged amino acid" refers to any amino acid, naturally-occurring or non-naturally occurring, comprising a negative charge on an atom of its side chain at a physiological pH. In certain aspects, the negative-charged amino acids are located at any of positions 37, 38, 39, 40, 41, 42, and 43. In specific embodiments, a negative-charged amino acid is located at position 40.

In other instances, the extension is acylated or alkylated as described herein and comprises 1-6 positive charged amino acids as described herein.

In yet other embodiments, the GIP agonist peptides which exhibit agonist activity at the GIP receptor comprises (i) SEQ ID NO: 1 with at least one amino acid modification, (ii) an extension of 1 to 21 amino acids (e.g., 5 to 18, 7 to 15, 9 to 12 amino acids) C-terminal to the amino acid at position 29 of the GIP agonist peptide, and (iii) an amino acid comprising an acyl or alkyl group which is non-native to a naturally-occurring amino acid which is located outside of the C-terminal extension (e.g., at any of positions 1-29). In some embodiments, the GIP agonist peptide comprises an acylated or alkylated amino acid at position 10. In particular aspects, the acyl or alkyl group is a C4 to C30 fatty acyl or C4 to C30 alkyl group. In some embodiments, the acyl or alkyl group is attached via a spacer, e.g., an amino acid, dipeptide, tripeptide, hydrophilic bifunctional spacer, hydrophobic bifunctional spacer). In certain aspects, the GIP agonist peptide comprises an amino acid modification which stabilizes the alpha helix, such as a salt bridge between a Glu at position 16 and a Lys at position 20, or an alpha,alpha-disubstituted amino acid at any one, two, three, or more of positions 16, 20, 21, and 24. In specific aspects, the GIP agonist peptide additionally comprises amino acid modifications which confer DPP-IV protease resistance, e.g., DMIA at position 1, AIB at position 2. GIP agonist peptides comprising further amino acid modifications are contemplated herein.

In certain embodiments, the GIP agonist peptides having GIP receptor activity exhibit at least 0.1% (e.g., at least 0.5%, 1%, 2%, 5%, 10%, 15%, or 20%) activity of native GIP at the GIP receptor when the GIP agonist peptide lacks a hydrophilic moiety, e.g., PEG. In some embodiments, the GIP agonist peptides exhibit more than 10%, (e.g., more than 20%, more than 50%, more than 75%, more than 100%, more than 200%, more than 300%, more than 500%) activity of native GIP at the GIP receptor. In some embodiments, the GIP agonist peptide exhibits appreciable agonist activity at one or both of the GLP-1 and glucagon receptors. In some aspects, the potency and/or selectivity for these receptors (GIP receptor and GLP-1 receptor and/or glucagon receptor) are within 1000-fold, 750-fold, 500-fold, 250-fold, or 100-fold (higher or lower). For example, the selectivity for the GLP-1 receptor of the GIP agonist peptides having GIP receptor activity can be less than 1000-fold, 500-fold, 100-fold, within 50-fold, within 25 fold, within 15 fold, within 10 fold) (higher or lower) the selectivity for the GIP receptor and/or the glucagon receptor.

In accordance with the foregoing, in some embodiments, the GIP agonist peptide is an analog of native glucagon (SEQ ID NO: 1) and the amino acid sequence of the peptide is SEQ ID NO: 1 with a stabilized alpha helix (e.g., a lactam bridge or alpha,alpha disubstituted amino acids), Leu-Ala-Gly as positions 27-29, Ile at position 12, an amino acid at position 1 that confers the peptide with GIP activity or an amino acid which reduces GIP activity as described herein. In accordance with the foregoing, in some embodiments, the GIP agonist peptide is an analog of native glucagon (SEQ ID NO: 1) and the amino acid sequence of the peptide is SEQ ID NO: 1 with an amino acid of Formula IV at position 16, and alpha,alpha disubstituted amino acid (e.g., AIB) at position 20, Leu-Ala-Gly as positions 27-29, Ile at position 12, an amino acid at position 1 that confers the peptide with GIP activity or an amino acid which reduces GIP activity as described herein.

In some embodiments, the GIP agonist peptide comprises a modification that reduces activity at the GIP receptor at position 1. The GIP agonist peptide may comprise such an amino acid modification so that the activity levels at the GIP receptor (e.g., EC50 or potency at the GIP receptor) are within about 50-fold, about 40-fold, about 30-fold, about 20 fold, about 10 fold, or about 5-fold of the IC50 of the glucagon antagonist of the peptide combination. In certain aspects, the amino acid modification which reduces GIP agonist activity is a substitution of His at position 1 with a small aliphatic residue, e.g., Ala, Gly. In some aspects, the amino acid modification which reduces GIP agonist activity is a deletion of the amino acid at position 1 or a deletion of the amino acids at positions 1 and 2. In specific aspects, the GIP agonist peptide is an analog of any of the amino acid sequences listed in Sequence Listing 2 in which Tyr is at position 1, wherein the analog comprises a small aliphatic residue at position 1, in lieu of the Tyr, or the analog lacks the amino acid at position 1 or at positions 1 and 2 of these amino acid sequences.

The following paragraphs which precede the section entitled "Activity of the Glucagon antagonist peptide" are provided to further describe the amino acid modifications referenced in the above section entitled "Exemplary embodiments of the GIP agonist peptide" and the section entitled "Additional modifications of the Glucagon antagonist peptide."

Modifications That Affect GIP Activity

Under normal circumstances, native human glucagon does not activate the GIP receptor in the human body. Described herein are modifications of the native human glucagon amino acid sequence which alter this hormone, such that it exhibits appreciable activity at the GIP receptor.

In specific aspects, the GIP agonist peptide of the present disclosures which exhibits enhanced activity at the GIP receptor (as compared to native glucagon) comprises an amino acid modification at position 1. For example, the His at position 1 of native glucagon is substituted with a large, aromatic amino acid, optionally Tyr, Phe, Trp, amino-Phe, nitro-Phe, chloro-Phe, sulfo-Phe, 4-pyridyl-Ala, methyl-Tyr, or 3-amino Tyr in the GIP agonist peptide.

In alternative embodiments, the GIP agonist peptide comprises a modification that reduces activity at the GIP receptor at position 1. The GIP agonist peptide may comprise such an amino acid modification so that the activity levels at the GIP receptor (e.g., EC50 or potency at the GIP receptor) are within about 50-fold, about 40-fold, about 30-fold, about 20 fold, about 10 fold, or about 5-fold of the IC50 of the glucagon antagonist of the peptide combination. In certain aspects, the amino acid modification which reduces GIP agonist activity is a substitution of His at position 1 with a small aliphatic residue, e.g., Ala, Gly. In some aspects, the amino acid modification which reduces GIP agonist activity is a deletion of the amino acid at position 1 or a deletion of the amino acids at positions 1 and 2.

In some embodiments, the GIP agonist peptide which exhibits enhanced activity at the GIP receptor (as compared to native glucagon) comprises an amino acid modification at one or all of positions 27, 28, and 29. In some embodiments, the GIP agonist peptide comprises the amino acid sequence of native glucagon in which (i) the Met at position 27 of the native glucagon amino acid sequence is substituted with a large aliphatic amino acid, optionally Leu, (ii) the Asn at position 28 of the native glucagon amino acid sequence is substituted with a small aliphatic amino acid, optionally Ala, (iii) the Thr at position 29 of the native glucagon amino acid sequence is substituted with a small aliphatic amino acid, optionally Gly, or any combination of (i), (ii), and (iii). Substitution with LAG at positions 27-29 provides increased GIP activity relative to the MNT sequence of native human glucagon at those positions.

In some embodiments, the GIP agonist peptide which exhibits enhanced activity at the GIP receptor (as compared to native glucagon) comprises an amino acid modification at position 12. For example, in some aspects, the amino acid at position 12 of the native glucagon amino acid sequence is substituted with a large, aliphatic, nonpolar amino acid, optionally Ile.

In certain aspects, the GIP agonist peptide which exhibits enhanced activity at the GIP receptor (as compared to native glucagon) comprises an amino acid modification at positions 17 and/or 18. For example, position 17 is substituted with a polar residue, optionally Gln, and position 18 is substituted with a small aliphatic amino acid, optionally Ala. A substitution with QA at positions 17 and 18 provides increased GIP activity relative to the native RR sequence at those positions.

In some embodiments, the GIP agonist peptide which exhibits increased activity at the GIP receptor (as compared to native glucagon) comprises an intramolecular bridge between the side chains of two amino acids located at any of positions from 12 to 29. In some aspects, the intramolecular bridge is formed between two amino acids that are not present in the native amino acid sequence of human glucagon. Accordingly, the GIP agonist peptide in some aspects comprises amino acid modifications, e.g., amino acid substitutions of the native human glucagon sequence, that permit bridge formation. For example, in some aspects, an intramolecular bridge is formed by a covalent bond between the side chains of two amino acids at positions i and i+4 or between positions j and j+3, or between positions k and k+7. In exemplary embodiments, the bridge is between positions 12 and 16, 16 and 20, and 24, 24 and 28, or 17 and 20. In other embodiments, non-covalent interactions such as salt bridges can be formed between positively and negatively charged amino acids at these positions. Intramolecular bridges within the C-terminal region of a glucagon-based peptide are further described herein. See "Stabilization of the Alpha Helix Structure"

In some embodiments, stabilization of the alpha helix structure in the C-terminal portion of the glucagon peptide (around amino acids 12-29) is achieved through purposeful introduction of one or more α,α-disubstituted amino acids at positions that retain the desired activity. In some embodiments, one, two, three, four or more of positions 16, 17, 18, 19, 20, 21, 24 or 29 of a glucagon peptide or analog thereof is substituted with an α,α-di substituted amino acid. For example, substitution of position 16 of a glucagon peptide or analog thereof with amino iso-butyric acid (AIB) provides a stabilized alpha helix in the absence of a salt bridge or lactam. Such peptides are considered herein as a peptide lacking an intramolecular bridge. In specific aspects, stabilization of the alpha-helix is accomplished by introducing one or more α,α-disubstituted amino acids without introduction of a covalent intramolecular bridge, e.g., a lactam bridge, a disulfide bridge. Such peptides are considered herein as a peptide lacking a covalent intramolecular bridge. In some embodiments, one, two, three or more of positions 16, 20, 21 or 24 are substituted with AIB. Further discussion of this type of amino acid modification is provided herein. See "Stabilization of the Alpha Helix Structure"

In some embodiments, the GIP agonist peptide comprises an extension of 1-21 amino acids C-terminal to the amino acid at position 29. The extension in some aspects comprises the amino acid sequence of SEQ ID NO: 3 or 4, for instance. In some aspects in which the extension comprises SEQ ID NO: 4, the Xaa is a small aliphatic residue, e.g., Gly. In some aspects, the extension comprises 1-6 charged amino acids. In some embodiments, the 1-6 amino acids are negative-charged amino acids, e.g., Asp, Glu. In some embodiments, the 1-6 amino acids are positive-charged amino acids, e.g., Arg, an amino acid of Formula IV (e.g., Dab, Orn, Lys, d-Lys, homoLys). The charged amino acid may be located at any of positions 37, 38, 39, 40, 41, 42, and 43. In some aspects, the charged amino acid is located at position 40. In further aspects, the charged amino acid is modified with an acyl or alkyl group as described herein in "Acylation and alkylation." In some aspects, the extension does not comprise a Lys at position 40.

Any of the modifications described above which provide an enhancement in GIP receptor activity can be applied individually or in combination. Combinations of the modifications that increase GIP receptor activity generally provide higher GIP activity than any of such modifications taken alone.

Modifications That Affect Glucagon Activity

In some aspects of the present disclosures, the GIP agonist peptide which is an analog of native human glucagon comprises an amino acid modification that selectively reduces glucagon receptor activity. In specific embodiments, the modification that reduces glucagon receptor activity is a modification of the amino acid at position 3, e.g. substitution of the naturally occurring glutamine at position 3, with an acidic, basic, or a hydrophobic amino acid. In exemplary embodiments, the GIP agonist peptide comprises the native human glucagon amino acid sequence in which the amino acid at position 3 is substituted with glutamic acid, ornithine, or norleucine. Such modifications have been found to substantially reduce or destroy glucagon receptor activity. Without being bound to any particular theory, such amino acid substitutions at position 3 dominate any other amino acid modification which enhances glucagon receptor activity, such that the net result is reduced or destroyed activity at the glucagon receptor.

Modifications that Affect GLP-1 Activity

Under normal circumstances, native human glucagon does not activate the GLP-1 receptor in the human body. Described herein are modifications of the native human glucagon amino acid sequence which alter this hormone, such that it exhibits appreciable activity at the GLP-1 receptor.

Accordingly, in some embodiments, the GIP agonist peptide of the present disclosures exhibits enhanced activity at both the GIP receptor and GLP-1 receptor (as compared to the activity of native glucagon at these receptors). In this regard, the GIP agonist peptide may be considered as a GIP/GLP-1 co-agonist peptide. The GIP agonist peptide which exhibits enhanced activity at the GLP-1 receptor in some embodiments comprises a charge-neutral group, such as an amide or ester, in place of the alpha carboxylic acid of the C-terminal amino acid. Thus, in some aspects, the GIP agonist peptide comprises C-terminal amidation or comprises a C-terminal amide in place of the alpha carboxylate of the C-terminal residue.

In some aspects, the GIP agonist peptide which exhibits enhanced activity at the GLP-1 receptor comprises a stabilized alpha-helix structure in the C-terminal portion of glucagon (around amino acids 12-29), e.g., through formation of an intramolecular bridge between the side chains of two amino acids, or substitution and/or insertion of amino acids around positions 12-29 with an alpha helix-stabilizing amino acid (e.g., an α,α-disubstituted amino acid), as further described herein. In exemplary embodiments, the side chains of the amino acid pairs 12 and 16, 13 and 17, 16 and 20, 17 and 21, 20 and 24 or 24 and 28 (amino acid pairs in which i=12, 16, 20, or 24) are linked to one another and thus stabilize the glucagon alpha helix. In some embodiments, the bridge or linker is about 8 (or about 7-9) atoms in length, particularly when the bridge is between positions i and i+4. In some embodiments, the bridge or linker is about 6 (or about 5-7) atoms in length, particularly when the bridge is between positions j and j+3.

In some embodiments, intramolecular bridges are formed by (a) substituting the naturally occurring serine at position 16 with glutamic acid or with another negatively charged amino acid having a side chain with a length of 4 atoms, or alternatively with any one of glutamine, homoglutamic acid, or homocysteic acid, or a charged amino acid having a side chain containing at least one heteroatom, (e.g. N, O, S, P) and with a side chain length of about 4 (or 3-5) atoms, and (b) substituting the naturally occurring glutamine at position 20 with another hydrophilic amino acid having a side chain that is either charged or has an ability to hydrogen-bond, and is at least about 5 (or about 4-6) atoms in length, for example, lysine, citrulline, arginine, or ornithine. The side chains of such amino acids at positions 16 and 20 can form a salt bridge or can be covalently linked. In some embodiments the two amino acids are bound to one another to form a lactam ring.

In some embodiments, stabilization of the alpha helix structure in the C-terminal portion of the GIP agonist peptide is achieved through the formation of an intramolecular bridge other than a lactam bridge. For example, suitable covalent bonding methods include any one or more of olefin metathesis, lanthionine-based cyclization, disulfide bridge or modified sulfur-containing bridge formation, the use of α,ω-diaminoalkane tethers, the formation of metal-atom bridges, and other means of peptide cyclization are used to stabilize the alpha helix.

In yet other embodiments, one or more α,α-disubstituted amino acids are inserted or substituted into this C-terminal portion (amino acids 12-29) at positions that retain the desired activity. For example, one, two, three or all of positions 16, 20, 21 or 24 are substituted with an α,α-disubstituted amino acid, e.g., AIB.

In some aspects, the GIP agonist peptide which exhibits increased activity at the GLP-1 receptor comprises an amino acid modification at position 20 as described herein.

In some embodiments, the GIP agonist peptide which exhibits increased activity at the GLP-1 receptor comprises GPSSGAPPPS (SEQ ID NO: 3) or XGPSSGAPPPS (SEQ ID NO: 4) at the C-terminus. GLP-1 activity in such analogs can be further increased by modifying the amino acid at position 18, 28 or 29, or at position 18 and 29, as described herein.

In some embodiments, the GIP agonist peptide which exhibits increased activity at the GLP-1 receptor comprises a large, aromatic amino acid residue, optionally Trp, at position 10.

In some embodiments in which the GIP agonist peptide exhibits enhanced activity at the GLP-1 receptor, the GIP agonist peptide comprises an alanine at position 18 instead of an arginine which is native to the human glucagon amino acid sequence.

Any of the modifications described above in reference to a GIP agonist peptide which exhibit increased GLP-1 receptor activity can be applied individually or in combination. Combinations of the modifications that increase GLP-1 receptor activity generally provide higher GLP-1 activity than any of such modifications taken alone. For example, the present disclosures provides GIP agonist peptides that comprise modifications at position 16, at position 20, and at the C-terminal carboxylic acid group, optionally with a covalent bond between the amino acids at positions 16 and 20; GIP agonist peptides that comprise modifications at position 16 and at the C-terminal carboxylic acid group; GIP agonist peptides that comprise modifications at positions 16 and 20, optionally with a covalent bond between the amino acids at positions 16 and 20; and GIP agonist peptides that comprise modifications at position 20 and at the C-terminal carboxylic acid group.

In some embodiments in which GLP-1 activity is not desired, GLP-1 activity may be reduced by specific amino acid modifications. In this regard, in some embodiments, the GIP agonist peptide comprises (i) a C-terminal alpha carboxylate group, (ii) a substitution of the Thr at position 7 with an amino acid lacking a hydroxyl group, e.g., Abu or Ile, (iii) a deletion of the amino acid(s) C-terminal to the amino acid at position 27 or 28 (e.g., deletion of the amino acid at position 28, deletion of the amino acid at positions 28 and 29) to yield a peptide 27 or 28 amino acids in length, or (iv) a combination thereof. In some aspects, an amino acid substitution at position 7 which reduces, if not destroys, GLP-1 receptor activity dominates any other amino acid modification which is described herein as one which enhances GLP-1 receptor activity, such that the net effect of the modifications would be reduced or destroyed activity at the GLP-1 receptor.

Modifications that Affect Activity at Each of the GIP, GLP-1, and Glucagon Receptors In some embodiments, the GIP agonist peptide comprises (i) an amino acid substitution of Ser at position 16 with an amino acid of Formula IV:

$$H_2N-\overset{H}{\underset{\underset{\underset{R_1}{N}\diagdown R_2}{(CH_2)_n}}{C}}-COOH,\quad [\text{Formula IV}]$$

wherein n is 1 to 16, or 1 to 10, or 1 to 7, or 1 to 6, or 2 to 6, or 2 or 3 or 4 or 5, each of $R_1$ and $R_2$ is independently selected from the group consisting of H, $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl)

($C_3$-$C_9$ heteroaryl), wherein $R_7$ is H or OH, and the side chain of the amino acid of Formula IV comprises a free amino group, and (ii) an amino acid substitution of the Gln at position 20 with an alpha,alpha-disubstituted amino acid, e.g., AIB. In some embodiments, the amino acid at position 16 is Orn, Dab, Lys, or homoLys, and the amino acid at position 20 is AIB. In specific embodiments, the amino acid at position 16 is Lys and the amino acid at position 20 is AIB.

The activity at each of the glucagon receptor, GLP-1 receptor, and glucagon receptor of the GIP agonist peptide comprising an amino acid of Formula IV at position 16 and an alpha, alpha di-substituted amino acid at position 20 can be further enhanced by extending the length of the peptide, e.g. by fusion to a C-terminal extension peptide, e.g. of about 1-21, about 9 to 21, about 6-18, about 9-12, or about 10 or 11 amino acids in length. In some embodiments, the C-terminus of the GIP agonist peptide is extended by fusion to GPSSGAPPPS (SEQ ID NO: 3) or XGPSSGAPPPS (SEQ ID NO: 4), wherein X is Gly or a small, aliphatic or non-polar or slightly polar amino acid. In alternative embodiments, the C-terminus of the GIP agonist peptide is extended by fusion to GPSSGAPPPS (SEQ ID NO: 3) and 1-11 amino acids are fused to the C-terminus of GPSSGAP-PPS (SEQ ID NO: 3). For example, the C-terminal extension of the analog can comprise GPSSGAPPPS (SEQ ID NO: 3) followed by 1, 2, 3, 4, 5, 6, 7, 8, 9, 10, or 11 additional amino acids at the C-terminus of SEQ ID NO: 3. The 1-11 additional amino acids can be, for example, a small aliphatic amino acid, such as Ala. In this regard, the GIP agonist peptide in some embodiments comprises a C-terminal extension comprising, for example, the amino acid sequence of GPSSGAPPPSA$_m$ (SEQ ID NO: 1320), wherein m is 1 to 11.

Enhancement of activity at each of the glucagon, GLP-1, and GIP receptors of the GIP agonist peptide, including one comprising an amino acid of Formula IV at position 16 and an alpha,alpha disubstituted amino acid at position 20, can furthermore be achieved upon acylation or alkylation of an amino acid located within a C-terminal extension or at the C-terminal amino acid (e.g., an amino acid which is added to the C-terminus of the C-terminal extension). The acylation or alkylation can be of an amino acid located, for example, at any of positions 30, 31, 32, 33, 34, 35, 36, 37, 38, 39, 40, 41, 42, 43, 44, 45, 46, 47, 48, 49, and 50 of the C-terminally extended GIP agonist peptide. In some embodiments, the amino acid which is acylated or alkylated is located at position 37, 38, 39, 40, 41, 42, or 43 of the C-terminally extended GIP agonist peptide. In some embodiments, the acylated or alkylated amino acid is an amino acid of Formula I, II, or III, e.g., Lys, which is attached to an acyl or alkyl group, e.g. C10-C22. In certain embodiments, the Lys is located C-terminal to a C-terminal extension consisting of SEQ ID NO: 3, such that the Lys, Dab, Orn, or homoLys is located at position 40 of the analog. Optionally, C-terminally extended peptides are also pegylated, e.g. at any of the positions described herein as suitable for pegylation (e.g., position 24).

Enhancement of the activity at each of the glucagon, GLP-1, and GIP receptors of a GIP-active, GIP agonist peptide can moreover be achieved by acylation or alkylation of an amino acid via a spacer (e.g., an amino acid, dipeptide, tripeptide, hydrophilic bifunctional spacer, hydrophobic bifunctional spacer). In some embodiments, the GIP-active, GIP agonist peptide comprises an acyl or alkyl group via a spacer, which spacer is attached to the side chain of the amino acid at position 10 of the analog. In other embodiments, the GIP agonist peptide comprises a C-terminal extension of 1 to 21 amino acids (e.g., an extension comprising the amino acid sequence of SEQ ID NO: 3 or 4) C-terminal to the amino acid at position 29 and the spacer, which is covalently attached to an acyl or alkyl group, is attached to an amino acid of the extension at a position corresponding to one of positions 37-43 relative to SEQ ID NO: 1. In specific embodiments, the spacer is attached to the amino acid at position 40 relative to SEQ ID NO: 1. In certain embodiments, the spacer is 3 to 10 atoms in length. In specific aspects, the total length of the spacer and acyl or alkyl group is about 14 to about 28 atoms in length. For example, the spacer can be an amino acid, including, but not limited to, any of those described herein. Also, for example, the spacer may be a dipeptide or tripeptide comprising amino acids described herein, e.g., a dipeptide or tripeptide spacer comprising acidic amino acids. The spacer in specific aspects is one of the following dipeptides: Ala-Ala, βAla-βAla, or γGlu-γGlu. Additional suitable spacers for purposes of increasing activity at one or more of the glucagon, GLP-1, and GIP receptors are further described herein.

In particular aspects of the present disclosures, the GIP agonist peptide comprises any of the modifications above which achieve enhanced activity at each of the GIP, GLP-1, and glucagon receptors, in addition to an amino acid modification which reduces glucagon activity, e.g., Glu at position 3. Without being bound to any particular theory, an amino acid substitution at position 3 which reduces, if not destroys, glucagon receptor activity dominates any other amino acid modification which enhances glucagon receptor activity, such that the net results would be reduced or destroyed activity at the glucagon receptor. Accordingly, in exemplary embodiments, the GIP agonist peptide comprises an amino acid of Formula IV at position 16, an alpha,alpha-disubstituted amino acid at position 20, a C-terminal extension in accordance with the above teachings comprising an acylated Lys residue at position 40, and a Glu at position 3. Such peptides exhibits little to no glucagon receptor activity.

Stabilization of the Alpha Helix Structure

Stabilization of the alpha-helix structure in the C-terminal portion of the GIP agonist peptide (around amino acids 12-29) provides enhanced GLP-1 and/or GIP activity and restores glucagon activity which has been reduced by amino acid modifications at positions 1 and/or 2. The alpha helix structure can be stabilized by, e.g., formation of a covalent or non-covalent intramolecular bridge, or substitution and/or insertion of amino acids around positions 12-29 with an alpha helix-stabilizing amino acid (e.g., an α,α-disubstituted amino acid).

In some embodiments, an intramolecular bridge is formed between two amino acid side chains to stabilize the three dimensional structure of the carboxy terminal portion (e.g., amino acids 12-29) of the GIP agonist peptide. The two amino acid side chains can be linked to one another through non-covalent bonds, e.g., hydrogen-bonding, ionic interactions, such as the formation of salt bridges, or by covalent bonds. When the two amino acid side chains are linked to one another through one or more covalent bonds, the peptide may be considered herein as comprising a covlent intramolecular bridge. When the two amino acid side chains are linked to one another through non-covalent bonds, e.g., hydrogen bonds, ionic interactions, the peptide may be considered herein as comprising a non-covalent intramolecular bridge.

In some embodiments, the intramolecular bridge is formed between two amino acids that are 3 amino acids apart, e.g., amino acids at positions i and i+4, wherein i is any integer between 12 and 25 (e.g., 12, 13, 14, 15, 16, 17, 18, 19, 20, 21, 22, 23, 24, and 25). More particularly, the side chains of the amino acid pairs 12 and 16, 16 and 20, 20 and 24 or 24 and 28 (amino acid pairs in which i=12, 16, 20, or 24) are linked to one another and thus stabilize the glucagon alpha helix. Alternatively, i can be 17.

In some specific embodiments, wherein the amino acids at positions i and i+4 are joined by an intramolecular bridge, the size of the linker is about 8 atoms, or about 7-9 atoms.

In other embodiments, the intramolecular bridge is formed between two amino acids that are two amino acids apart, e.g., amino acids at positions j and j+3, wherein j is any integer between 12 and 26 (e.g., 12, 13, 14, 15, 16, 17, 18, 19, 20, 21, 22, 23, 24, 25, and 26). In some specific embodiments, j is 17.

In some specific embodiments, wherein amino acids at positions j and j+3 are joined by an intramolecular bridge, the size of the linker is about 6 atoms, or about 5 to 7 atoms.

In yet other embodiments, the intramolecular bridge is formed between two amino acids that are 6 amino acids apart, e.g., amino acids at positions k and k+7, wherein k is any integer between 12 and 22 (e.g., 12, 13, 14, 15, 16, 17, 18, 19, 20, 21, and 22). In some specific embodiments, k is 12, 13, or 17. In an exemplary embodiment, k is 17.

Examples of amino acid pairings that are capable of covalently bonding to form a six-atom linking bridge include Orn and Asp, Glu and an amino acid of Formula I, wherein n is 2, and homoglutamic acid and an amino acid of Formula I, wherein n is 1, wherein Formula I is:

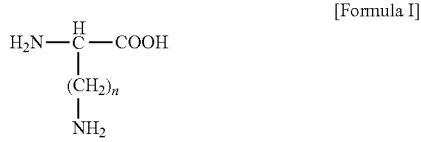

[Formula I]

wherein n = 1 to 4

Examples of amino acid pairing that are capable of covalently bonding to form a seven-atom linking bridge include Orn-Glu (lactam ring); Lys-Asp (lactam); or Homoser-Homoglu (lactone). Examples of amino acid pairings that may form an eight-atom linker include Lys-Glu (lactam); Homolys-Asp (lactam); Orn-Homoglu (lactam); 4-aminoPhe-Asp (lactam); or Tyr-Asp (lactone). Examples of amino acid pairings that may form a nine-atom linker include Homolys-Glu (lactam); Lys-Homoglu (lactam); 4-aminoPhe-Glu (lactam); or Tyr-Glu (lactone). Any of the side chains on these amino acids may additionally be substituted with additional chemical groups, so long as the three-dimensional structure of the alpha-helix is not disrupted. One of ordinary skill in the art can envision alternative pairings or alternative amino acid analogs, including chemically modified derivatives, that would create a stabilizing structure of similar size and desired effect. For example, a homocysteine-homocysteine disulfide bridge is 6 atoms in length and may be further modified to provide the desired effect. Even without covalent linkage, the amino acid pairings described above or similar pairings that one of ordinary skill in the art can envision may also provide added stability to the alpha-helix through non-covalent bonds, for example, through formation of salt bridges or hydrogen-bonding interactions.

The size of a lactam ring can vary depending on the length of the amino acid side chains, and in one embodiment the lactam is formed by linking the side chains of a lysine amino acid to a glutamic acid side chain. Further exemplary embodiments include the following pairings, optionally with a lactam bridge: Glu at position 12 with Lys at position 16; native Lys at position 12 with Glu at position 16; Glu at position 16 with Lys at position 20; Lys at position 16 with Glu at position 20; Glu at position 20 with Lys at position 24; Lys at position 20 with Glu at position 24; Glu at position 24 with Lys at position 28; Lys at position 24 with Glu at position 28. Alternatively, the order of the amide bond in the lactam ring can be reversed (e.g., a lactam ring can be formed between the side chains of a Lys 12 and a Glu16 or alternatively between a Glu 12 and a Lys16).

Intramolecular bridges other than a lactam bridge can be used to stabilize the alpha helix of the GIP agonist peptides. In one embodiment, the intramolecular bridge is a hydrophobic bridge. In this instance, the intramolecular bridge optionally is between the side chains of two amino acids that are part of the hydrophobic face of the alpha helix of the GIP agonist peptide. For example, one of the amino acids joined by the hydrophobic bridge can be the amino acid at position 10, 14, and 18.

In one specific aspect, olefin metathesis is used to cross-link one or two turns of the alpha helix of the GIP agonist peptide using an all-hydrocarbon cross-linking system. The GIP agonist peptide in this instance can comprise α-methylated amino acids bearing olefinic side chains of varying length and configured with either R or S stereochemistry at the and i+4 or i+7 positions. For example, the olefinic side can can comprise $(CH_2)_n$, wherein n is any integer between 1 to 6. In one embodiment, n is 3 for a cross-link length of 8 atoms. Suitable methods of forming such intramolecular bridges are described in the art. See, for example, Schafineister et al., *J. Am. Chem. Soc.* 122: 5891-5892 (2000) and Walensky et al., *Science* 305: 1466-1470 (2004). Alternatively, the GIP agonist peptide can comprise O-allyl Ser residues located on adjacent helical turns, which are bridged together via ruthenium-catalyzed ring closing metathesis. Such procedures of cross-linking are described in, for example, Blackwell et al., *Angew, Chem., Int. Ed.* 37: 3281-3284 (1998).

In another specific aspect, use of the unnatural thio-dialanine amino acid, lanthionine, which has been widely adopted as a peptidomimetic of cystine, is used to cross-link one turn of the alpha helix. Suitable methods of lanthionine-based cyclization are known in the art. See, for instance, Matteucci et al., *Tetrahedron Letters* 45: 1399-1401 (2004); Mayer et al., *J. Peptide Res.* 51: 432-436 (1998); Polinsky et al., *J. Med. Chem.* 35: 4185-4194 (1992); Osapay et al., *J. Med. Chem.* 40: 2241-2251 (1997); Fukase et al., *Bull. Chem. Soc. Jpn.* 65: 2227-2240 (1992); Harpp et al., *J. Org. Chem.* 36: 73-80 (1971); Goodman and Shao, *Pure Appl. Chem.* 68: 1303-1308 (1996); and Osapay and Goodman, *J. Chem. Soc. Chem. Commun.* 1599-1600 (1993).

In some embodiments, α,ω-diaminoalkane tethers, e.g., 1,4-diaminopropane and 1,5-diaminopentane) between two Glu residues at positions i and i+7 are used to stabilize the alpha helix of the GIP agonist peptide. Such tethers lead to the formation of a bridge 9-atoms or more in length, depending on the length of the diaminoalkane tether. Suitable methods of producing peptides cross-linked with such tethers are described in the art. See, for example, Phelan et al., *J. Am. Chem. Soc.* 119: 455-460 (1997).

In yet another embodiment of the present disclosures, a disulfide bridge is used to cross-link one or two turns of the alpha helix of the GIP agonist peptide. Alternatively, a modified disulfide bridge in which one or both sulfur atoms are replaced by a methylene group resulting in an isosteric macrocyclization is used to stabilize the alpha helix of the GIP agonist peptide. Suitable methods of modifying peptides with disulfide bridges or sulfur-based cyclization are described in, for example, Jackson et al., *J. Am. Chem. Soc.* 113: 9391-9392 (1991) and Rudinger and Jost, *Experientia* 20: 570-571 (1964).

In yet another embodiment, the alpha helix of the GIP agonist peptide is stabilized via the binding of metal atom by two His residues or a His and Cys pair positioned at i and i+4. The metal atom can be, for example, Ru(III), Cu(II), Zn(II), or Cd(II). Such methods of metal binding-based alpha helix stabilization are known in the art. See, for example, Andrews and Tabor, *Tetrahedron* 55: 11711-11743 (1999); Ghadiri et al., *J. Am. Chem. Soc.* 112: 1 630-1 632 (1990); and Ghadiri et al., *J. Am. Chem. Soc.* 119: 9063-9064 (1997).

The alpha helix of the GIP agonist peptide can alternatively be stabilized through other means of peptide cyclizing, which means are reviewed in Davies, *J. Peptide. Sci.* 9: 471-501 (2003). The alpha helix can be stabilized via the formation of an amide bridge, thioether bridge, thioester bridge, urea bridge, carbamate bridge, sulfonamide bridge, and the like. For example, a thioester bridge can be formed between the C-terminus and the side chain of a Cys residue. Alternatively, a thioester can be formed via side chains of amino acids having a thiol (Cys) and a carboxylic acid (e.g., Asp, Glu). In another method, a cross-linking agent, such as a dicarboxylic acid, e.g. suberic acid (octanedioic acid), etc. can introduce a link between two functional groups of an amino acid side chain, such as a free amino, hydroxyl, thiol group, and combinations thereof.

In accordance with one embodiment, the alpha helix of the GIP agonist peptide is stabilized through the incorporation of hydrophobic amino acids at positions i and i+4. For instance, i can be Tyr and i+4 can be either Val or Leu; i can be Phe and i+4 can be Cys or Met; I can be Cys and i+4 can be Met; or i can be Phe and i+4 can be Ile. It should be understood that, for purposes herein, the above amino acid pairings can be reversed, such that the indicated amino acid at position i could alternatively be located at i+4, while the i+4 amino acid can be located at the i position.

In accordance with other embodiments of the present disclosures, the alpha helix is stabilized through incorporation (either by amino acid substitution or insertion) of one or more alpha helix-stabilizing amino acids at the C-terminal portion of the GIP agonist peptide (around amino acids 12-29). In a specific embodiment, the alpha helix-stabilizing amino acid is an α,α-disubstituted amino acid, including, but not limited to any of amino iso-butyric acid (AIB), an amino acid disubstituted with the same or a different group selected from methyl, ethyl, propyl, and n-butyl, or with a cyclooctane or cycloheptane (e.g., 1-aminocyclooctane-1-carboxylic acid). In some embodiments, one, two, three, four or more of positions 16, 17, 18, 19, 20, 21, 24 or 29 of the GIP agonist peptide is substituted with an α,α-disubstituted amino acid. In a specific embodiment, one, two, three or all of positions 16, 20, 21, and 24 are substituted with an α,α-disubstituted amino acid, e.g., AIB, and the GIP agonist peptide optionally lacks any purposefully-introduced intramolecular bridges. For example, the GIP agonist peptide can comprise a substitution of position 16 or 20 with AIB in the absence of an intramolecular bridge, e.g., a non-covalent intramolecular bridge (e.g., a salt bridge) or a covalent intramolecular bridge (e.g., a lactam). Such peptides lacking an intramolecular bridge are advantageously easy to prepare.

In accordance with some embodiments, the GIP agonist peptide lacking an intramolecular bridge comprises one or more substitutions within amino acid positions 12-29 with an α,α-disubstituted amino acid and an acyl or alkyl group covalently attached to the side chain of an amino acid of the GIP agonist peptide, e.g., the amino acid at positions 10 or 40 of the GIP agonist peptide. In specific embodiments, the acyl or alkyl group is non-native to a naturally occurring amino acid. In certain aspects, the acyl or alkyl group is non-native to the amino acid at position 10. Such acylated or alkylated GIP agonist peptides lacking an intramolecular bridge exhibit enhanced activity at the GLP-1 and glucagon receptors as compared to the non-acylated counterpart peptides. Further enhancement in activity at the GLP-1 and glucagon receptors can be achieved by the acylated GIP agonist peptides lacking an intramolecular bridge by incorporating a spacer between the acyl or alkyl group and the side chain of the amino acid at positions 10 or 40 of the peptide. Acylation and alkylation, with or without incorporating spacers, are further described herein.

In specific embodiments, the acylated or alkylated GIP agonist peptide, or analog thereof, further comprises a modification which selectively reduces activity at the GLP-1 receptor. For example, the acylated or alkylated GIP agonist peptide, or analog thereof, comprises one or a combination of: a C-terminal alpha carboxylate, a deletion of the amino acids C-terminal to the amino acid at position 27 or 28 (e.g., deletion of the amino acid at position 29, deletion of the amino acids at positions 28 and 29), a substitution of the Thr at position 7 with a large, aliphatic, non-polar amino acid, e.g., Ile. In some aspects, the GIP agonist peptide of the present disclosures comprises an amino acid modification which selectively reduces glucagon receptor activity. Such modifications are described further herein.

In some embodiments, position 16 or position 20 is substituted with an α,α-disubstituted amino acid, e.g., AIB. In some embodiments, position 20 is substituted with an α,α-disubstituted amino acid, e.g., AIB. In certain embodiments, position 20 is substituted with an α,α-disubstituted amino acid, e.g., AIB, and position 16 is substituted with an amino acid of Formula IV

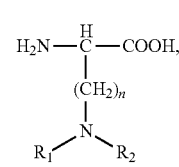

[Formula IV]

wherein n is 1 to 16, or 1 to 10, or 1 to 7, or 1 to 6, or 2 to 6, or 2 or 3 or 4 or 5, each of $R_1$ and $R_7$ is independently selected from the group consisting of H, $C_1$-$C_{18}$ alkyl, ($C_1$-$C_{18}$ alkyl)OH, ($C_1$-$C_{18}$ alkyl)NH$_2$, ($C_1$-$C_{18}$ alkyl)SH, ($C_0$-$C_4$ alkyl)($C_3$-$C_6$)cycloalkyl, ($C_0$-$C_4$ alkyl)($C_2$-$C_5$ heterocyclic), ($C_0$-$C_4$ alkyl)($C_6$-$C_{10}$ aryl)$R_7$, and ($C_1$-$C_4$ alkyl) ($C_3$-$C_9$ heteroaryl), wherein $R_7$ is H or OH, and the side chain of the amino acid of Formula IV comprises a free amino group. In particular embodiments, the amino acid of Formula IV is 2,3 diamino propionic acid (DAP), 2,4-diaminobutyric acid (DAB), Orn, Lys or homoLys. The combination of an amino acid of Formula IV at position 16 and an alpha,alpha disubstituted amino acid advantageously provides improved activity at each of the glucagon, GLP-1, and GIP receptors. In some aspects, this peptide further comprises an amino acid modification which selectively reduces activity at the glucagon receptor, e.g., a substitution of the Gln at position 3 with Glu.

Acylation and Alkylation

In accordance with some embodiments, the GIP agonist peptide of the present disclosures are modified to comprise an acyl group or an alkyl group, e.g., an acyl or alkyl group which is non-native to a naturally-occurring amino acid. Acylation or alkylation can increase the half-life of the GIP agonist peptides in circulation. Acylation or alkylation can advantageously delay the onset of action and/or extend the duration of action at the glucagon and/or GLP-1 receptors and/or improve resistance to proteases such as DPP-IV and/or improve solubility. Activity at the glucagon and/or GLP-1 and/or GIP receptors of the GIP agonist peptide may be maintained after acylation. In some embodiments, the potency of the acylated GIP agonist peptides is comparable to the unacylated versions of the GIP agonist peptides. In alternative embodiments, the potency of the acylated GIP agonist peptides is increased as compared to that of the unacylated version of the GIP agonist peptides.

In some embodiments, the GIP agonist peptide is modified to comprise an acyl group or alkyl group covalently linked to the amino acid at position 10 of the GIP agonist peptide. The GIP agonist peptide may further comprise a spacer between the amino acid at position 10 of the GIP agonist peptide and the acyl group or alkyl group. In some embodiments, the acyl group is a fatty acid or bile acid, or salt thereof, e.g. a C4 to C30 fatty acid, a C8 to C24 fatty acid, cholic acid, a C4 to C30 alkyl, a C8 to C24 alkyl, or an alkyl comprising a steroid moiety of a bile acid. The spacer is any moiety with suitable reactive groups for attaching acyl or alkyl groups. In exemplary embodiments, the spacer comprises an amino acid, a dipeptide, a tripeptide, a hydrophilic bifunctional, or a hydrophobic bifunctional spacer. In some embodiments, the spacer is selected from the group consisting of: Trp, Glu, Asp, Cys and a spacer comprising $NH_2(CH_2CH_2O)n(CH_2)mCOOH$, wherein m is any integer from 1 to 6 and n is any integer from 2 to 12. Such acylated or alkylated GIP agonist peptides may also further comprise a hydrophilic moiety, optionally a polyethylene glycol. Any of the foregoing GIP agonist peptides may comprise two acyl groups or two alkyl groups, or a combination thereof.

Acylation can be carried out at any position within the GIP agonist peptide, including any of positions 1-29, a position within a C-terminal extension, or the N- or C-terminal amino acid, provided that GIP activity (and optionally GLP-1 and/or glucagon activity) is retained, if not enhanced. Acylation may occur, for example, at any amino acid which is added to the amino acid sequence (SEQ ID NO: 1), e.g., at the N- or C-terminus. Nonlimiting examples include positions 1, 5, 10, 11, 12, 13, 14, 16, 17, 18, 19, 20, 21, 24, 27, 28, 29, 30, 31, 32, 33, 34, 35, 36, 37, 38, 39, 40, 41, 42, 43, 44, 45, 46, 47, 48, 49, or 50 of the GIP agonist peptide. The acyl group can be covalently linked directly to an amino acid of the GIP agonist peptide, or indirectly to an amino acid of the GIP agonist peptide via a spacer, wherein the spacer is positioned between the amino acid of the GIP agonist peptide and the acyl group. GIP agonist peptides may be acylated at the same amino acid position where a hydrophilic moiety is linked, or at a different amino acid position. Nonlimiting examples include acylation at position 10 or position 40 and pegylation at one or more positions in the C-terminal portion of the GIP agonist peptide, e.g., position 24, 28 or 29, within a C-terminal extension, or at the C-terminus (e.g., through adding a C-terminal Cys).

In some embodiments, the GIP agonist peptide is modified to comprise an extension of about 1 to about 21 amino acids C-terminal to the GIP agonist peptide of SEQ ID NO: 1 or an analog thereof and at least one of the amino acids of the extension is acylated or alkylated. For example, the modified GIP agonist peptide may comprise an extension of about 1 to about 21 amino acids C-terminal to the amino acid at position 29 of the GIP agonist peptide of SEQ ID NO: 1 or analog thereof. Alternatively, if the GIP agonist peptide or analog thereof is truncated by one or two amino acids, the extension of about 1 to about 21 amino acids may be C-terminal to the amino acid at position 27 or 28 of the GIP agonist peptide or analog thereof. Accordingly, the acylated or alkylated amino acid within the C-terminal extension can be, for example, any of the amino acids at position 28, 29, 30, 31, 32, 33, 34, 35, 36, 37, 38, 39, 40, 41, 42, 43, 44, 45, 46, 47, 48, 49, or 50 of the C-terminally extended GIP agonist peptide. The C-terminal extension in some embodiments comprises the amino acid sequence of SEQ ID NO: 3 or 4. In some embodiments, the GIP agonist peptide comprises a C-terminal extension comprising the amino acid sequence of SEQ ID NO: 3 and 1 to 11 additional amino acids at the C-terminus of SEQ ID NO: 3, which additional amino acid(s) is/are acylated or alkylated, as described herein. In specific embodiments, the acylated or alkylated amino acid is a Dab, Orn, Lys, or homoLys residue and is located at position 40 of the C-terminally extended GIP agonist peptide or analog thereof.

In accordance with one embodiment, the GIP agonist peptide is modified to comprise an acyl group which is attached to the GIP agonist peptide via an ester, thioester, or amide linkage for purposes of prolonging half-life in circulation and/or delaying the onset of and/or extending the duration of action and/or improving resistance to proteases such as DPP-IV.

In a specific aspect of the present disclosures, the GIP agonist peptide is modified to comprise an acyl group by direct acylation of an amine, hydroxyl, or thiol of a side chain of an amino acid of the GIP agonist peptide. In some embodiments, the GIP agonist peptide is directly acylated through the side chain amine, hydroxyl, or thiol of an amino acid. In some embodiments, acylation is at position 10, 20, 24, 29, or 40. In this regard, the acylated GIP agonist peptide can comprise the amino acid sequence of SEQ ID NO: 1, or a modified amino acid sequence thereof comprising one or more of the amino acid modifications described herein, with at least one of the amino acids at positions 10, 20, 24, 29, and 40 modified to any amino acid comprising a side chain amine, hydroxyl, or thiol. In some specific embodiments of the present disclosures, the direct acylation of the GIP agonist peptide occurs through the side chain amine, hydroxyl, or thiol of the amino acid at position 10 or 40.

In some embodiments, the amino acid comprising a side chain amine is an amino acid of Formula I:

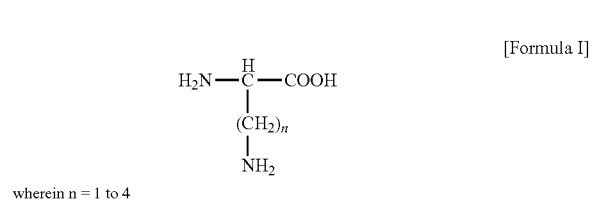

[Formula I]

wherein n = 1 to 4

In some exemplary embodiments, the amino acid of Formula I, is the amino acid wherein n is 4 (Lys) or n is 3 (Orn).

In other embodiments, the amino acid comprising a side chain hydroxyl is an amino acid of Formula II:

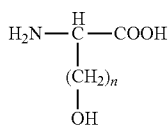

[Formula II]

wherein n = 1 to 4

In some exemplary embodiments, the amino acid of Formula II is the amino acid wherein n is 1 (Ser).

In yet other embodiments, the amino acid comprising a side chain thiol is an amino acid of Formula III:

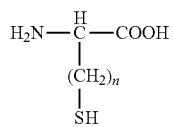

[Formula III]

wherein n = 1 to 4

In some exemplary embodiments, the amino acid of Formula II is the amino acid wherein n is 1 (Cys).

In yet other embodiments, the amino acid comprising a side chain amine, hydroxyl, or thiol is a disubstituted amino acid comprising the same structure of Formula I, Formula II, or Formula III, except that the hydrogen bonded to the alpha carbon of the amino acid of Formula I, Formula II, or Formula III is replaced with a second side chain.

In certain embodiments of the present disclosures, the acylated GIP agonist peptide comprises a spacer between the peptide and the acyl group. In some embodiments, the GIP agonist peptide is covalently bound to the spacer, which is covalently bound to the acyl group.

The amino acid to which the spacer is attached can be any amino acid (e.g., a singly or doubly α-substituted amino acid) comprising a moiety which permits linkage to the spacer. For example, an amino acid comprising a side chain $NH_2$, —OH, or —COOH (e.g., Lys, Orn, Ser, Asp, or Glu) is suitable. In this respect, the acylated GIP agonist peptide can comprise the amino acid sequence of SEQ ID NO: 1, or a modified amino acid sequence thereof comprising one or more of the amino acid modifications described herein, with at least one of the amino acids at positions 10, 20, 24, 29, and 40 modified to any amino acid comprising a side chain amine, hydroxyl, or carboxylate.

In some embodiments, the spacer is an amino acid comprising a side chain amine, hydroxyl, or thiol, or a dipeptide or tripeptide comprising an amino acid comprising a side chain amine, hydroxyl, or thiol.

When acylation occurs through an amine group of a spacer the acylation can occur through the alpha amine of the amino acid or a side chain amine. In the instance in which the alpha amine is acylated, the spacer amino acid can be any amino acid. For example, the spacer amino acid can be a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, and 8-aminooctanoic acid. Alternatively, the spacer amino acid can be an acidic residue, e.g., Asp and Glu.

In the instance in which the side chain amine of the spacer amino acid is acylated, the spacer amino acid is an amino acid comprising a side chain amine, e.g., an amino acid of Formula I (e.g., Lys or Orn). In this instance, it is possible for both the alpha amine and the side chain amine of the spacer amino acid to be acylated, such that the GIP agonist peptide is diacylated. Embodiments of the present disclosures include such diacylated molecules.

When acylation occurs through a hydroxyl group of a spacer, the amino acid or one of the amino acids of the dipeptide or tripeptide can be an amino acid of Formula II. In a specific exemplary embodiment, the amino acid is Ser.

When acylation occurs through a thiol group of a spacer, the amino acid or one of the amino acids of the dipeptide or tripeptide can be an amino acid of Formula III. In a specific exemplary embodiment, the amino acid is Cys.

In some embodiments, the spacer is a hydrophilic bifunctional spacer. In certain embodiments, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate. In specific embodiments, the spacer comprises an amino poly (alkyloxy)carboxylate. In this regard, the spacer can comprise, for example, $NH_2(CH_2CH_2O)_n(CH_2)_mCOOH$, wherein m is any integer from 1 to 6 and n is any integer from 2 to 12, such as, e.g., 8-amino-3,6-dioxaoctanoic acid, which is commercially available from Peptides International, Inc. (Louisville, Ky.).

In some embodiments, the spacer is a hydrophobic bifunctional spacer. Hydrophobic bifunctional spacers are known in the art. See, e.g., *Bioconjugate Techniques*, G. T. Hermanson (Academic Press, San Diego, Calif., 1996), which is incorporated by reference in its entirety. In certain embodiments, the hydrophobic bifunctional spacer comprises two or more reactive groups, e.g., an amine, a hydroxyl, a thiol, and a carboxyl group or any combinations thereof. In certain embodiments, the hydrophobic bifunctional spacer comprises a hydroxyl group and a carboxylate. In other embodiments, the hydrophobic bifunctional spacer comprises an amine group and a carboxylate. In other embodiments, the hydropholic bifunctional spacer comprises a thiol group and a carboxylate. Suitable hydrophobic bifunctional spacers comprising a carboxylate, and a hydroxyl group or a thiol group are known in the art and include, for example, 8-hydroxyoctanoic acid and 8-mercaptooctanoic acid.

In some embodiments, the bifunctional spacer is not a dicarboxylic acid comprising an unbranched, methylene of 1-7 carbon atoms between the carboxylate groups. In some embodiments, the bifunctional spacer is a dicarboxylic acid comprising an unbranched, methylene of 1-7 carbon atoms between the carboxylate groups.

The spacer (e.g., amino acid, dipeptide, tripeptide, hydrophilic bifunctional, or hydrophobic bifunctional spacer) in specific embodiments is 3 to 10 atoms (e.g., 6 to 10 atoms, (e.g., 6, 7, 8, 9, or 10 atoms) in length. In more specific embodiments, the spacer is about 3 to 10 atoms (e.g., 6 to 10 atoms) in length and the acyl group is a C12 to C18 fatty acyl group, e.g., C14 fatty acyl group, C16 fatty acyl group, such that the total length of the spacer and acyl group is 14 to 28 atoms, e.g., about 14, 15, 16, 17, 18, 19, 20, 21, 22, 23, 24, 25, 26, 27, or 28 atoms. In some embodiments, the length of the spacer and acyl group is 17 to 28 (e.g., 19 to 26, 19 to 21) atoms.

In accordance with certain foregoing embodiments, the bifunctional spacer can be a synthetic or naturally occurring amino acid (including, but not limited to, any of those described herein) comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer can be a dipeptide or tripeptide spacer having a peptide backbone that is 3 to 10 atoms (e.g., 6 to 10 atoms) in length. Each amino acid of the dipeptide or tripeptide spacer can be the same as or different from the other amino acid(s) of the dipeptide or tripeptide and can be independently selected from the group consisting of: naturally-occurring and/or non-naturally occurring amino acids, including, for example, any of the D or L isomers of the naturally-occurring amino acids (Ala, Cys, Asp, Glu, Phe, Gly, His, Ile, Lys, Leu, Met, Asn, Pro, Arg, Ser, Thr, Val, Trp, Tyr), or any D or L isomers of the non-naturally occurring amino acids selected from the group consisting of: β-alanine (β-Ala), N-α-methyl-alanine (Me-Ala), aminobutyric acid (Abu), γ-aminobutyric acid (γ-Abu), aminohexanoic acid (s-Ahx), aminoisobutyric acid (Aib), aminomethylpyrrole carboxylic acid, aminopiperidinecarboxylic acid, aminoserine (Ams), aminotetrahydropyran-4-carboxylic acid, arginine N-methoxy-N-methyl amide, β-aspartic acid (β-Asp), azetidine carboxylic acid, 3-(2-benzothiazolyl)alanine, α-tert-butylglycine, 2-amino-5-ureido-n-valeric acid (citrulline, Cit), β-Cyclohexylalanine (Cha), acetamidomethyl-cysteine, diaminobutanoic acid (Dab), diaminopropionic acid (Dpr), dihydroxyphenylalanine (DOPA), dimethylthiazolidine (DMTA), γ-Glutamic acid (γ-Glu), homoserine (Hse), hydroxyproline (Hyp), isoleucine N-methoxy-N-methyl amide, methyl-isoleucine (MeIle), isonipecotic acid (Isn), methyl-leucine (MeLeu), methyl-lysine, dimethyl-lysine, trimethyl-lysine, methanoproline, methionine-sulfoxide (Met(O)), methionine-sulfone (Met($O_2$)), norleucine (Nle), methyl-norleucine (Me-Nle), norvaline (Nva), ornithine (Orn), para-aminobenzoic acid (PABA), penicillamine (Pen), methylphenylalanine (MePhe), 4-Chlorophenylalanine (Phe(4-Cl)), 4-fluorophenylalanine (Phe(4-F)), 4-nitrophenylalanine (Phe(4-$NO_2$)), 4-cyanophenylalanine ((Phe(4-CN)), phenylglycine (Phg), piperidinylalanine, piperidinylglycine, 3,4-dehydroproline, pyrrolidinylalanine, sarcosine (Sar), selenocysteine (Sec), O-Benzyl-phosphoserine, 4-amino-3-hydroxy-6-methylheptanoic acid (Sta), 4-amino-5-cyclohexyl-3-hydroxypentanoic acid (ACHPA), 4-amino-3-hydroxy-5-phenylpentanoic acid (AHPPA), 1,2,3,4,-tetrahydro-isoquinoline-3-carboxylic acid (Tic), tetrahydropyranglycine, thienylalanine (Thi), O-benzyl-phosphotyrosine, O-Phosphotyrosine, methoxytyrosine, ethoxytyrosine, O-(bis-dimethylamino-phosphono)-tyrosine, tyrosine sulfate tetrabutylamine, methyl-valine (MeVal), and alkylated 3-mercaptopropionic acid.

In some embodiments, the spacer comprises an overall negative charge, e.g., comprises one or two negatively charged amino acids, e.g., one or two acidic residues. In some embodiments, the dipeptide is not any of the dipeptides of general structure A-B, wherein A is selected from the group consisting of Gly, Gln, Ala, Arg, Asp, Asn, Ile, Leu, Val, Phe, and Pro, wherein B is selected from the group consisting of Lys, His, Trp.

In some exemplary embodiments, the GIP agonist peptide is modified to comprise an acyl group by acylation of an amine, hydroxyl, or thiol of a spacer, which spacer is attached to a side chain of an amino acid at position 10, 20, 24, 29, or 40, or at the C-terminal amino acid of the GIP agonist peptide.

In yet more specific embodiments, the acyl group is attached to the amino acid at position 10 or 40 of the GIP agonist peptide and, optionally, the length of the spacer and acyl group is 14 to 28 atoms. The amino acid at position 10 or 40, in some aspects, is an amino acid of Formula I, e.g., Lys, or a disubstituted amino acid related to Formula I. In more specific embodiments, the GIP agonist peptide lacks an intramolecular bridge, e.g., a covalent intramolecular bridge. The GIP agonist peptide, for example, can be a peptide comprising one or more alpha,alpha-disubstituted amino acids, e.g., AIB, for stabilizing the alpha helix of the peptide. As shown herein, such peptides comprising an acylated spacer covalently attached to the side chain of the amino acid at position 40 exhibit enhanced potency at the GIP, GLP-1, and glucagon receptors. Peptides comprising the same structure except further comprising an amino acid modification which selectively reduces activity at the glucagon receptor (e.g., substitution of Gln 3 for Glu) are further contemplated herein.

Suitable methods of peptide acylation via amines, hydroxyls, and thiols are known in the art. See, for example, Example 19 (for methods of acylating through an amine), Miller, *Biochem Biophys Res Commun* 218: 377-382 (1996); Shimohigashi and Stammer, *Int J Pept Protein Res* 19: 54-62 (1982); and Previero et al., *Biochim Biophys Acta* 263: 7-13 (1972) (for methods of acylating through a hydroxyl); and San and Silvius, *J Pept Res* 66: 169-180 (2005) (for methods of acylating through a thiol); *Bioconjugate Chem*. "Chemical Modifications of Proteins: History and Applications" pages 1, 2-12 (1990); Hashimoto et al., *Pharmacuetical Res*. "Synthesis of Palmitoyl Derivatives of Insulin and their Biological Activity" Vol. 6, No: 2 pp. 171-176 (1989).

The acyl group of the acylated GIP agonist peptide can be of any size, e.g., any length carbon chain, and can be linear or branched. In some specific embodiments of the present disclosures, the acyl group is a C4 to C30 fatty acid. For example, the acyl group can be any of a C4 fatty acid, C6 fatty acid, C8 fatty acid, C10 fatty acid, C12 fatty acid, C14 fatty acid, C16 fatty acid, C18 fatty acid, C20 fatty acid, C22 fatty acid, C24 fatty acid, C26 fatty acid, C28 fatty acid, or a C30 fatty acid. In some embodiments, the acyl group is a C8 to C20 fatty acid, e.g., a C14 fatty acid or a C16 fatty acid.

In an alternative embodiment, the acyl group is a bile acid. The bile acid can be any suitable bile acid, including, but not limited to, cholic acid, chenodeoxycholic acid, deoxycholic acid, lithocholic acid, taurocholic acid, glycocholic acid, and cholesterol acid.

In some embodiments of the present disclosures, the GIP agonist peptide is modified to comprise an acyl group by acylation of a long chain alkane by the GIP agonist peptide. In specific aspects, the long chain alkane comprises an amine, hydroxyl, or thiol group (e.g. octadecylamine, tetradecanol, and hexadecanethiol) which reacts with a carboxyl group, or activated form thereof, of the GIP agonist peptide. The carboxyl group, or activated form thereof, of the GIP agonist peptide can be part of a side chain of an amino acid (e.g., glutamic acid, aspartic acid) of the GIP agonist peptide or can be part of the peptide backbone.

In certain embodiments, the GIP agonist peptide is modified to comprise an acyl group by acylation of the long chain alkane by a spacer which is attached to the GIP agonist peptide. In specific aspects, the long chain alkane comprises an amine, hydroxyl, or thiol group which reacts with a carboxyl group, or activated form thereof, of the spacer. Suitable spacers comprising a carboxyl group, or activated form thereof, are described herein and include, for example, bifunctional spacers, e.g., amino acids, dipeptides, tripeptides, hydrophilic bifunctional spacers and hydrophobic bifunctional spacers.

As used herein, the term "activated form of a carboxyl group" refers to a carboxyl group with the general formula R(C=O)X, wherein X is a leaving group and R is the GIP agonist peptide or the spacer. For example, activated forms of a carboxyl groups may include, but are not limited to, acyl chlorides, anhydrides, and esters. In some embodiments, the activated carboxyl group is an ester with a N-hydroxysuccinimide ester (NHS) leaving group.

With regard to these aspects of the present disclosures, in which a long chain alkane is acylated by the GIP agonist peptide or the spacer, the long chain alkane may be of any size and can comprise any length of carbon chain. The long chain alkane can be linear or branched. In certain aspects, the long chain alkane is a C4 to C30 alkane. For example, the long chain alkane can be any of a C4 alkane, C6 alkane, C8 alkane, C10 alkane, C12 alkane, C14 alkane, C16 alkane, C18 alkane, C20 alkane, C22 alkane, C24 alkane, C26 alkane, C28 alkane, or a C30 alkane. In some embodiments, the long chain alkane comprises a C8 to C20 alkane, e.g., a C14 alkane, C16 alkane, or a C18 alkane.

Also, in some embodiments, an amine, hydroxyl, or thiol group of the GIP agonist peptide is acylated with a cholesterol acid. In specific embodiments, the GIP agonist peptide is linked to the cholesterol acid through a modified Cys spacer.

The acylated GIP agonist peptides described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In this regard, the acylated GIP agonist peptide can comprise SEQ ID NO: 1, including any of the modifications described herein, in which at least one of the amino acids at position 10, 20, 24, 29, and 40 comprise an acyl group and at least one of the amino acids at position 16, 17, 21, 24, 29, or 40, a position within a C-terminal extension, or the C-terminal amino acid are modified to a Cys, Lys, Orn, homo-Cys, or Ac-Phe, and the side chain of the amino acid is covalently bonded to a hydrophilic moiety (e.g., PEG). In some embodiments, the acyl group is attached to position 10 or 40, optionally via a spacer comprising Cys, Lys, Orn, homo-Cys, or Ac-Phe, and the hydrophilic moiety is incorporated at a Cys residue at position 24.

Alternatively, the acylated GIP agonist peptide can comprise a spacer, wherein the spacer is both acylated and modified to comprise the hydrophilic moiety. Nonlimiting examples of suitable spacers include a spacer comprising one or more amino acids selected from the group consisting of Cys, Ac-Cys, Lys, Orn, homo-Cys, and Ac-Phe.

In a specific aspect of the present disclosures, the acylated GIP agonist peptide comprises the amino acid sequence of any of SEQ ID NOs:201-206, 213-215, 217-219, 223-225, 228-230, 232-234, 236-238, 241-245, 248, 251, 252, 254, 256, 258, 260, 262, 263, 265, 266, 331, 334-339, 357, and 358, and optionally, further comprises an amino acid modification which selectively reduces activity at the glucagon receptor, e.g., substitution of Gln 3 with Glu.

In accordance with some embodiments, the GIP agonist peptide is modified to comprise an alkyl group, e.g., an alkyl group which is not naturally-occurring on an amino acid (e.g., an alkyl group which is non-native to a naturally-occurring amino acid). Without being held to any particular theory, it is believed that alkylation of the GIP agonist peptide of the present disclosures achieves similar, if not the same, effects as acylation of the GIP agonist peptides, e.g., a prolonged half-life in circulation, a delayed onset of action, an extended duration of action, an improved resistance to proteases, such as DPP-IV, and increased potency at the GLP-1, GIP, and glucagon receptors.

Alkylation can be carried out at any positions within the GIP agonist peptide, including any of positions 1-29, a position within a C-terminal extension, or the N- or C-terminal amino acid, provided that the GIP activity (and optionally GLP-1 and/or glucagon activity) is retained, if not enhanced. Alkylation may occur, for example, at any amino acid which is added to the amino acid sequence (SEQ ID NO: 1), e.g., at the N- or C-terminus. Nonlimiting examples include positions 1, 5, 10, 11, 12, 13, 14, 16, 17, 18, 19, 20, 21, 24, 27, 28, 29, 30, 31, 32, 33, 34, 35, 36, 37, 38, 39, 40, 41, 42, 43, 44, 45, 46, 47, 48, 49, or 50. The alkyl group can be covalently linked directly to an amino acid of the GIP agonist peptide, or indirectly to an amino acid of the GIP agonist peptide via a spacer, wherein the spacer is positioned between the amino acid of the GIP agonist peptide and the alkyl group. GIP agonist peptides may be alkylated at the same amino acid position where a hydrophilic moiety is linked, or at a different amino acid position. Nonlimiting examples include alkylation at position 10 or 40 and pegylation at one or more positions in the C-terminal portion of the GIP agonist peptide, e.g., position 24, 28 29, or 40, within a C-terminal extension, or at the C-terminus (e.g., through adding a C-terminal Cys).

In a specific aspect of the present disclosures, the GIP agonist peptide is modified to comprise an alkyl group by direct alkylation of an amine, hydroxyl, or thiol of a side chain of an amino acid of the GIP agonist peptide. In some embodiments, the GIP agonist peptide is directly alkylated through the side chain amine, hydroxyl, or thiol of an amino acid. In some embodiments, alkylation is at position 10, 20, 24, 29, or 40. In this regard, the alkylated GIP agonist peptide can comprise the amino acid sequence of SEQ ID NO: 1, or a modified amino acid sequence thereof comprising one or more of the amino acid modifications described herein, with at least one of the amino acids at positions 10, 20, 24, 29, and 40 modified to any amino acid comprising a side chain amine, hydroxyl, or thiol. In some specific embodiments of the present disclosures, the direct alkylation of the GIP agonist peptide occurs through the side chain amine, hydroxyl, or thiol of the amino acid at position 10.

In some embodiments, the amino acid comprising a side chain amine is an amino acid of Formula I. In some exemplary embodiments, the amino acid of Formula I, is the amino acid wherein n is 4 (Lys) or n is 3 (Orn).

In other embodiments, the amino acid comprising a side chain hydroxyl is an amino acid of Formula II. In some exemplary embodiments, the amino acid of Formula II is the amino acid wherein n is 1 (Ser).

In yet other embodiments, the amino acid comprising a side chain thiol is an amino acid of Formula III. In some exemplary embodiments, the amino acid of Formula III is the amino acid wherein n is 1 (Cys).

In yet other embodiments, the amino acid comprising a side chain amine, hydroxyl, or thiol is a disubstituted amino acid comprising the same structure of Formula I, Formula II, or Formula III, except that the hydrogen bonded to the alpha carbon of the amino acid of Formula I, Formula II, or Formula III is replaced with a second side chain.

In one embodiment of the present disclosures, the alkylated GIP agonist peptide comprises a spacer between the peptide and the alkyl group. In some embodiments, the GIP agonist peptide is covalently bound to the spacer, which is covalently bound to the alkyl group. In some exemplary embodiments, the GIP agonist peptide is modified to comprise an alkyl group by alkylation of an amine, hydroxyl, or thiol of a spacer, which spacer is attached to a side chain of an amino acid at position 10, 20, 24, 29, or 40 of the GIP agonist peptide. The amino acid to which the spacer is attached can be any amino acid (e.g., a singly α-substituted amino acid or an α,α-disubstituted amino acid) comprising a moiety which permits linkage to the spacer. For example, an amino acid comprising a side chain $NH_2$, —OH, or —COOH (e.g., Lys, Orn, Ser, Asp, or Glu) is suitable. In this respect, the alkylated GIP agonist peptide can comprise the amino acid sequence of SEQ ID NO: 1, or a modified amino acid sequence thereof comprising one or more of the amino acid modifications described herein, with at least one of the amino acids at positions 10, 20, 24, 29, and 40 modified to any amino acid comprising a side chain amine, hydroxyl, or carboxylate.

In some embodiments, the spacer is an amino acid comprising a side chain amine, hydroxyl, or thiol or a dipeptide or tripeptide comprising an amino acid comprising a side chain amine, hydroxyl, or thiol.

When alkylation occurs through an amine group of a spacer the alkylation can occur through the alpha amine of the amino acid or a side chain amine. In the instance in which the alpha amine is alkylated, the spacer amino acid can be any amino acid. For example, the spacer amino acid can be a hydrophobic amino acid, e.g., Gly, Ala, Val, Leu, Ile, Trp, Met, Phe, Tyr, 6-amino hexanoic acid, 5-aminovaleric acid, 7-aminoheptanoic acid, and 8-aminooctanoic acid. Alternatively, the spacer amino acid can be an acidic residue, e.g., Asp and Glu, provided that the alkylation occurs on the alpha amine of the acidic residue. In the instance in which the side chain amine of the spacer amino acid is alkylated, the spacer amino acid is an amino acid comprising a side chain amine, e.g., an amino acid of Formula I (e.g., Lys or Orn). In this instance, it is possible for both the alpha amine and the side chain amine of the spacer amino acid to be alkylated, such that the GIP agonist peptide is dialkylated. Embodiments of the present disclosures include such dialkylated molecules.

When alkylation occurs through a hydroxyl group of a spacer, the amino acid or one of the amino acids of the dipeptide or tripeptide can be an amino acid of Formula II. In a specific exemplary embodiment, the amino acid is Ser. When acylation occurs through a thiol group of spacer, the amino acid or one of the amino acids of the dipeptide or tripeptide can be an amino acid of Formula III. In a specific exemplary embodiment, the amino acid is Cys.

In some embodiments, the spacer is a hydrophilic bifunctional spacer. In certain embodiments, the hydrophilic bifunctional spacer comprises two or more reactive groups, e.g., an amine, a hydroxyl, a thiol, and a carboxyl group or any combinations thereof. In certain embodiments, the hydrophilic bifunctional spacer comprises a hydroxyl group and a carboxylate. In other embodiments, the hydrophilic bifunctional spacer comprises an amine group and a carboxylate. In other embodiments, the hydrophilic bifunctional spacer comprises a thiol group and a carboxylate. In a specific embodiment, the spacer comprises an amino poly(alkyloxy)carboxylate. In this regard, the spacer can comprise, for example, $NH_2(CH_2CH_2O)_n(CH_2)_mCOOH$, wherein m is any integer from 1 to 6 and n is any integer from 2 to 12, such as, e.g., 8-amino-3,6-dioxaoctanoic acid, which is commercially available from Peptides International, Inc. (Louisville, Ky.).

In some embodiments, the spacer is a hydrophobic bifunctional spacer. In certain embodiments, the hydrophobic bifunctional spacer comprises two or more reactive groups, e.g., an amine, a hydroxyl, a thiol, and a carboxyl group or any combinations thereof. In certain embodiments, the hydrophobic bifunctional spacer comprises a hydroxyl group and a carboxylate. In other embodiments, the hydropholic bifunctional spacer comprises an amine group and a carboxylate. In other embodiments, the hydropholic bifunctional spacer comprises a thiol group and a carboxylate. Suitable hydrophobic bifunctional spacers comprising a carboxylate, and a hydroxyl group or a thiol group are known in the art and include, for example, 8-hydroxyoctanoic acid and 8-mercaptooctanoic acid.

The spacer (e.g., amino acid, dipeptide, tripeptide, hydrophilic bifunctional, or hydrophobic bifunctional spacer) in specific embodiments is 3 to 10 atoms (e.g., 6 to 10 atoms, (e.g., 6, 7, 8, 9, or 10 atoms)) in length. In more specific embodiments, the spacer is about 3 to 10 atoms (e.g., 6 to 10 atoms) in length and the alkyl is a C12 to C18 alkyl group, e.g., C14 alkyl group, C16 alkyl group, such that the total length of the spacer and alkyl group is 14 to 28 atoms, e.g., about 14, 15, 16, 17, 18, 19, 20, 21, 22, 23, 24, 25, 26, 27, or 28 atoms. In some embodiments, the length of the spacer and alkyl is 17 to 28 (e.g., 19 to 26, 19 to 21) atoms.

In accordance with certain foregoing embodiments, the bifunctional spacer can be a synthetic or non-naturally occurring amino acid comprising an amino acid backbone that is 3 to 10 atoms in length (e.g., 6-amino hexanoic acid, 5-aminovaleric acid, 7-aminoheptanoic acid, and 8-aminooctanoic acid). Alternatively, the spacer can be a dipeptide or tripeptide spacer having a peptide backbone that is 3 to 10 atoms (e.g., 6 to 10 atoms) in length. The dipeptide or tripeptide spacer can be composed of naturally-occurring and/or non-naturally occurring amino acids, including, for example, any of the amino acids taught herein. In some embodiments, the spacer comprises an overall negative charge, e.g., comprises one or two negatively charged amino acids, e.g., one or two acidic residues. In some embodiments, the dipeptide spacer is selected from the group consisting of: Ala-Ala, β-Ala-β-Ala, Leu-Leu, Pro-Pro, γ-aminobutyric acid-γ-aminobutyric acid, and γ-Glu-γ-Glu.

Suitable methods of peptide alkylation via amines, hydroxyls, and thiols are known in the art. For example, a Williamson ether synthesis can be used to form an ether linkage between a hydroxyl group of the GIP agonist peptide and the alkyl group. Also, a nucleophilic substitution reaction of the peptide with an alkyl halide can result in any of an ether, thioether, or amino linkage.

The alkyl group of the alkylated GIP agonist peptide can be of any size, e.g., any length carbon chain, and can be linear or branched. In some embodiments of the present disclosures, the alkyl group is a C4 to C30 alkyl. For example, the alkyl group can be any of a C4 alkyl, C6 alkyl, C8 alkyl, C10 alkyl, C12 alkyl, C14 alkyl, C16 alkyl, C18 alkyl, C20 alkyl, C22 alkyl, C24 alkyl, C26 alkyl, C28 alkyl, or a C30 alkyl. In some embodiments, the alkyl group is a C8 to C20 alkyl, e.g., a C14 alkyl or a C16 alkyl.

In some specific embodiments, the alkyl group comprises a steroid moiety of a bile acid, e.g., cholic acid, chenodeoxycholic acid, deoxycholic acid, lithocholic acid, taurocholic acid, glycocholic acid, and cholesterol acid.

In some embodiments of the present disclosures, the GIP agonist peptide is modified to comprise an alkyl group by reacting a nucleophilic, long chain alkane with the GIP agonist peptide, wherein the GIP agonist peptide comprises a leaving group suitable for nucleophilic substitution. In specific aspects, the nucleophilic group of the long chain alkane comprises an amine, hydroxyl, or thiol group (e.g. octadecylamine, tetradecanol, and hexadecanethiol). The leaving group of the GIP agonist peptide can be part of a side chain of an amino acid or can be part of the peptide backbone. Suitable leaving groups include, for example, N-hydroxysuccinimide, halogens, and sulfonate esters.

In certain embodiments, the GIP agonist peptide is modified to comprise an alkyl group by reacting the nucleophilic, long chain alkane with a spacer which is attached to the GIP agonist peptide, wherein the spacer comprises the leaving group. In specific aspects, the long chain alkane comprises an amine, hydroxyl, or thiol group. In certain embodiments, the spacer comprising the leaving group can be any spacer discussed herein, e.g., amino acids, dipeptides, tripeptides, hydrophilic bifunctional spacers and hydrophobic bifunctional spacers further comprising a suitable leaving group.

With regard to these aspects of the present disclosures, in which a long chain alkane is alkylated by the GIP agonist peptide or the spacer, the long chain alkane may be of any size and can comprise any length of carbon chain. The long chain alkane can be linear or branched. In certain aspects, the long chain alkane is a C4 to C30 alkane. For example, the long chain alkane can be any of a C4 alkane, C6 alkane, C8 alkane, C10 alkane, C12 alkane, C14 alkane, C16 alkane, C18 alkane, C20 alkane, C22 alkane, C24 alkane, C26 alkane, C28 alkane, or a C30 alkane. In some embodiments, the long chain alkane comprises a C8 to C20 alkane, e.g., a C14 alkane, C16 alkane, or a C18 alkane.

Also, in some embodiments, alkylation can occur between the GIP agonist peptide and a cholesterol moiety. For example, the hydroxyl group of cholesterol can displace a leaving group on the long chain alkane to form a cholesterol-GIP agonist peptide product.

The alkylated GIP agonist peptides described herein can be further modified to comprise a hydrophilic moiety. In some specific embodiments the hydrophilic moiety can comprise a polyethylene glycol (PEG) chain. The incorporation of a hydrophilic moiety can be accomplished through any suitable means, such as any of the methods described herein. In this regard, the alkylated GIP agonist peptide can comprise SEQ ID NO: 1, or a modified amino acid sequence thereof comprising one or more of the amino acid modifications described herein, in which at least one of the amino acids at position 10, 20, 24, 29, and 40 comprise an alkyl group and at least one of the amino acids at position 16, 17, 21, 24, 29, and 40, a position within a C-terminal extension or the C-terminal amino acid are modified to a Cys, Lys, Orn, homo-Cys, or Ac-Phe, and the side chain of the amino acid is covalently bonded to a hydrophilic moiety (e.g., PEG). In some embodiments, the alkyl group is attached to position 10 or 40, optionally via a spacer comprising Cys, Lys, Orn, homo-Cys, or Ac-Phe, and the hydrophilic moiety is incorporated at a Cys residue at position 24.

Alternatively, the alkylated GIP agonist peptide can comprise a spacer, wherein the spacer is both alkylated and modified to comprise the hydrophilic moiety. Nonlimiting examples of suitable spacers include a spacer comprising one or more amino acids selected from the group consisting of Cys, Lys, Orn, homo-Cys, and Ac-Phe.

Modifications that Improve DPP-IV Resistance

In some aspects of the present disclosures, the GIP agonist peptide comprises one or two modifications at position 1 and/or 2 which increase the peptide's resistance to dipeptidyl peptidase IV (DPP IV) cleavage. In exemplary embodiments, the amino acid at position 2 of the GIP agonist peptide is substituted with one of: D-serine, D-alanine, valine, glycine, N-methyl serine, N-methyl alanine, or amino isobutyric acid (AIB). In exemplary embodiments, the amino acid at position 1 of the GIP agonist peptide is substituted with one of: D-histidine, desaminohistidine, hydroxyl-histidine, acetyl-histidine, homo-histidine, N-methyl histidine, alpha-methyl histidine, imidazole acetic acid, or alpha,alpha-dimethyl imidiazole acetic acid (DMIA). In some aspects, the GIP agonist peptide comprising an amino acid modification which increases resistance to DPP IV further comprises an intramolecular bridge or alpha, alpha di-substituted amino acid, and optionally an amino acid modification which selectively reduces the activity at the glucagon receptor, such as, for example, a substitution of Gln3 with Glu.

Modifications That Reduce Degradation

In exemplary embodiments, any of the GIP agonist peptides of the present disclosures can be further modified to improve stability of the peptide by modifying the amino acid at position 15 and/or 16 of SEQ ID NO: 1 to reduce degradation of the peptide over time, especially in acidic or alkaline buffers. Such modifications reduce cleavage of the Asp15-Ser16 peptide bond. In exemplary embodiments, the amino acid modification at position 15 is a deletion or substitution of Asp with glutamic acid, homoglutamic acid, cysteic acid or homocysteic acid. In other exemplary embodiments, the amino acid modification at position 16 is a deletion or substitution of Ser with Thr or AIB. In alternative or additional embodiments, Ser at position 16 is substituted with glutamic acid or with another negatively charged amino acid having a side chain with a length of 4 atoms, or alternatively with any one of glutamine, homoglutamic acid, or homocysteic acid. Such modifications can reduce degradation or cleavage at a pH within the range of 5.5 to 8, for example, retaining at least 75%, 80%, 90%, 95%, 96%, 97%, 98% or 99%, up to 100% of the original peptide after 24 hours at 25° C. Such modifications reduce cleavage of the peptide bond between Asp15-Ser16.

In some embodiments, the GIP agonist peptide comprises a modification which prevents oxidative degradation of the peptide. In some aspects, the methionine residue at position 27 of the native glucagon peptide is modified, e.g. by deletion or substitution. In some embodiments, the Met at position 27 is substituted with leucine, isoleucine or norleucine. In some specific embodiments, Met at position 27 is substituted with leucine or norleucine.

In some embodiments, the GIP agonist peptide comprises one or more modifications that reduce degradation through deamidation of Gln. In some aspects, the Gln at position 20 and/or 24 of the GIP agonist peptide is modified, e.g. by deletion or substitution. In some embodiments, the Gln at position 20 and/or 24 of the GIP agonist peptide is substituted with Ser, Thr, Ala or AIB. In some embodiments the Gln at position 20 and/or 24 of the GIP agonist peptide is substituted with Lys, Arg, Orn, or Citrulline.

In some embodiments, the GIP agonist peptide comprises an amino acid modification which reduces degradation through dehydration of Asp to form a cyclic succinimide intermediate followed by isomerization to iso-aspartate. Accordingly, in some aspects, the Asp at position 21 of the GIP agonist peptide is modified, e.g. by deletion or substitution. In some embodiments, position 21 of the GIP agonist peptide is substituted with Glu, homoglutamic acid or homocysteic acid. In some specific embodiments, position 21 is substituted with Glu.

Modifications that Enhance Solubility

In another embodiment, the solubility of any of the GIP agonist peptides is improved by one or more amino acid substitutions and/or additions that introduce a charged amino acid into the C-terminal portion of the peptide, preferably at a position C-terminal to position 27 of SEQ ID NO: 1. Optionally, one, two or three charged amino acids are introduced within the C-terminal portion, preferably C-terminal to position 27. In some embodiments of the present disclosures, the native amino acid(s) at positions 28 and/or 29 are substituted with one or two charged amino acids, and/or in further embodiments one to three charged amino acids are also added to the C-terminus of the GIP agonist peptide. In exemplary embodiments, one, two or all of the charged amino acids are negative-charged or acidic amino acids. In some embodiments, the negative-charged or acidic amino acids are aspartic acid or glutamic acid. In other embodiments, one, two, three or all of the charged amino acids are positively charged. Such modifications increase solubility, e.g. provide at least 2-fold, 5-fold, 10-fold, 15-fold, 25-fold, 30-fold or greater solubility relative to native glucagon at a given pH between about 5.5 and 8, e.g., pH 7, when measured after 24 hours at 25° C.

The addition of a hydrophilic moiety also can enhance solubility of the GIP agonist peptide. Hydrophilic moieties and conjugation thereof to peptides is further described herein. See, "Conjugates." In exemplary embodiments, the GIP agonist peptide is conjugated to a hydrophilic moiety, e.g., polyethylene glycol, at position 16, 17, 20, 21, 24 or 29 of the GIP agonist peptide, within a C-terminal extension, and/or at the C-terminal amino acid of the peptide. Such modifications also enhance the duration of action or half-life of the peptide in circulation.

Other Modifications

Additional modifications, e.g. conservative substitutions, may be made to the GIP agonist peptide that still allow it to retain GIP activity (and optionally GLP-1 activity and/or glucagon activity). Exemplary modifications include but are not limited to the following:

Non-conservative or conservative substitutions, additions or deletions that do not substantially affect activity, for example, conservative substitutions at one or more of positions 2, 5, 9, 10, 11, 12, 13, 14, 15, 16, 17, 18, 19, 20, 21, 24, 27, 28 or 29; substitution of one or more of these positions with Ala; deletion of amino acids at one or more of positions 27, 28 or 29; or deletion of amino acid 29 optionally combined with a C-terminal amide or ester in place of the C-terminal carboxylic acid group; substitution of Lys at position 12 with Arg; substitution of Tyr at position 10 with Val or Phe;

Preservation of activity after pegylation is provided by the addition of GPSSGAPPPS (SEQ ID NO: 3) to the C-terminus.

In some embodiments, position 18 is substituted with an amino acid selected from the group consisting of Ala, Ser, or Thr. In some embodiments the amino acid at position 20 is substituted with Ser, Thr, Lys, Arg, Orn, Citrulline or AIB. In some embodiments, position 21 is substituted with Glu, homoglutamic acid or homocysteic acid. In some embodiments, the GIP agonist peptide comprises 1 to 10 amino acid modifications selected from positions 16, 17, 18, 20, 21, 23, 24, 27, 28 and 29. In exemplary embodiments, the modifications are one or more amino acid substitutions selected from the group consisting of Gln17, Ala18, Glu21, Ile23, Ala24, Va127 and Gly29. In some embodiments, 1 to 5 amino acids selected from positions 17-26 differ from the parent peptide. In other embodiments, 1 to 5 amino acids selected from positions 17-24 differ from the parent peptide. In yet other embodiments, the modifications are Gln17, Ala18, Glu21, Ile23 and Ala24.

In some embodiments, one or more amino acids is added to the carboxy terminus of the GIP agonist peptide. The amino acid is typically selected from one of the 20 common amino acids, and in some embodiments the amino acid has an amide group in place of the carboxylic acid of the native amino acid. In exemplary embodiments the added amino acid is selected from the group consisting of glutamic acid and aspartic acid and glycine.

Other modifications that do not destroy activity include W10 or R20.

In some embodiments, the GIP agonist peptides disclosed herein are modified by truncation of the C-terminus by one or two amino acid residues yet retain similar activity and potency at the glucagon, GLP-1 and/or GIP receptors. In this regard, the amino acid at position 29 and/or 28 can be deleted.

Activity of the Glucagon Antagonist Peptide

Glucagon Receptor Antagonism

In some embodiments of the present disclosures, the glucagon antagonist peptide exhibits at least or about 60% inhibition of the maximum response of native glucagon at the glucagon receptor. In exemplary embodiments, the glucagon antagonist peptide exhibits at least or about 65%, at least or about 70%, at least or about 75%, at least or about 80%, at least or about 85%, at least or about 90%, at least or about 95%, or at least or about 100% inhibition of the maximum response of native glucagon at the glucagon receptor. Accordingly, the glucagon antagonist peptide binds to the glucagon receptor and counteracts glucagon activity or prevents glucagon function.

In some aspects of the present disclosures, the glucagon antagonist peptide has an IC50 at the glucagon receptor which is in the micromolar range. In exemplary embodiments, the IC50 of the glucagon antagonist peptide at the glucagon receptor is less than 1000 µM, less than 900 µM, less than 800 µM, less than 700 µM, less than 600 µM, less than 500 µM, less than 400 µM, less than 300 µM, less than 200 µM. In some embodiments, the IC50 of the glucagon antagonist peptide at the glucagon receptor is about 100 µM or less, e.g., about 75 µM or less, about 50 µM or less, about 25 µM or less, about 10 µM or less, about 8 µM or less, about 6 µM or less, about 5 µM or less, about 4 µM or less, about 3 µM or less, about 2 µM or less, or about 1 µM or less.

In some aspects of the present disclosures, the glucagon antagonist peptide has an IC50 at the glucagon receptor which is in the nanomolar range. In exemplary embodiments, the IC50 of the glucagon antagonist peptide at the glucagon receptor is less than 1000 nM, less than 900 nM, less than 800 nM, less than 700 nM, less than 600 nM, less than 500 nM, less than 400 nM, less than 300 nM, less than 200 nM. In some embodiments, the IC50 of the glucagon antagonist peptide at the glucagon receptor is about 100 nM or less, e.g., about 75 nM or less, about 50 nM or less, about 25 nM or less, about 10 nM or less, about 8 nM or less, about 6 nM or less, about 5 nM or less, about 4 nM or less, about 3 nM or less, about 2 nM or less, or about 1 nM or less. In some aspects, the IC50 of the glucagon antagonist at the glucagon receptor is between 0.1 nM and 500 nM. In some aspects, the IC50 is about 0.1 nM or about 500 nM. In some embodiments, the glucagon antagonist peptide exhibits an IC50 for glucagon receptor activation which is in the picomolar range. In exemplary embodiments, the IC50 of the glucagon antagonist peptide at the glucagon receptor is less than 1000 pM, less than 900 pM, less than 800 pM, less than 700 pM, less than 600 pM, less than 500 pM, less than 400 pM, less than 300 pM, less than 200 pM. In some embodiments, the IC50 of the glucagon antagonist peptide at the glucagon receptor is about 100 pM or less, e.g., about 75 pM or less, about 50 pM or less, about 25 pM or less, about 10 pM or less, about 8 pM or less, about 6 pM or less, about 5 pM or less, about 4 pM or less, about 3 pM or less, about 2 pM or less, or about 1 pM or less.

In some embodiments, the glucagon antagonist peptide is a glucagon antagonist which, at a concentration of about 1 µM, exhibits less than or about 20% of the maximum agonist activity achieved by glucagon at the glucagon receptor. In some embodiments, the glucagon antagonist peptide is a glucagon antagonist which exhibits less than or about 15%, less than or about 10%, less than or about 5%, less than or about 1%, or about 0% of the maximum agonist activity achieved by glucagon at the glucagon receptor, when the peptide present at a concentration of about 1 µM.

In some aspects, the glucagon antagonist peptide is a "full antagonist" at the glucagon receptor and in other aspects, the glucagon antagonist peptide is a "partial antagonist" at the glucagon receptor By "full antagonist" as used herein is meant an antagonist that binds to the receptor and does not exhibit any agonist activity at the receptor it antagonizes. The term "partial antagonist" as used herein is synonymous with "partial agonist" which is a compound that exhibits a lower amount of agonist activity at a receptor as compared to a full agonist, but the partial agonist serves as an antagonist since its occupation of a receptor prevents the full agonist from binding, thereby producing a net decrease in the receptor activation as compared to the level of receptor activation if all receptors were bound by full agonists.

In some aspects of the present disclosures, the glucagon antagonist peptide exhibits activity (agonist or antagonist) at only one receptor. Accordingly, the glucagon antagonist peptide is some aspects is a "pure glucagon antagonist" and does not produce any detected stimulation of the glucagon receptor or any other receptor, including, e.g., the GLP-1 receptor, the GIP receptor, as measured by cAMP production using a validated in vitro model assay, such as that described in Example 2. For example, a pure glucagon antagonist exhibits less than about 5% (e.g., less than about 4%, less than about 3%, less than about 2%, less than about 1%, about 0%) of the maximum agonist activity achieved by glucagon at the glucagon receptor and exhibits less than about 5% (e.g., less than about 4%, less than about 3%, less than about 2%, less than about 1%, and about 0%) of the maximum agonist activity achieved by GLP-1 at the GLP-1 receptor and/or exhibits less than about 5% (e.g., less than about 4%, less than about 3%, less than about 2%, less than about 1%, and about 0%) of the maximum agonist activity achieved by GIP at the GIP receptor.

In other embodiments of the present disclosures, the glucagon antagonist peptide exhibits activity (agonist or antagonist) at more than one receptor. In such embodiments, the glucagon antagonist peptide has lost selectivity for one receptor over another. For example, the glucagon antagonist peptide in some embodiments is a glucagon receptor antagonist and an antagonist or agonist at another receptor, e.g., GLP-1 receptor and/or GIP receptor. The glucagon antagonist peptide in some embodiments exhibits mixed properties insofar as it exhibits antagonist activity at the glucagon receptor and agonist activity at another receptor, e.g., the GLP-1 receptor, the GIP receptor. By way of example, the glucagon antagonist peptide in some aspects exhibits both antagonist activity at the glucagon receptor and agonist activity at the GLP-1 receptor ("Glucagon receptor antagonist/GLP-1 receptor agonists"). In some aspects, the glucagon antagonist peptide has any of the IC50s at the glucagon receptor described herein and has any of the EC50s at the GLP-1 receptor described herein. In some embodiments, the IC50 of the glucagon antagonist peptide at the glucagon receptor is less than or about 50-fold, less than or about 40-fold, less than or about 30-fold, or less than or about 20-fold different (higher or lower) from its EC50 at the GLP-1 receptor. In some embodiments, the ratio of the IC50 of the glucagon antagonist peptide at the glucagon receptor divided by the EC50 of the glucagon antagonist peptide at the GLP-1 receptor is less than about 100, 75, 60, 50, 40, 30, 20, 15, 10, or 5, and no less than 1. In some embodiments, the ratio of the EC50 of the glucagon antagonist peptide at the GLP-1 receptor divided by the IC50 of the glucagon antagonist peptide at the glucagon receptor is less than about 100, 75, 60, 50, 40, 30, 20, 15, 10, or 5, and no less than 1.

Activity of Conjugates

In some embodiments, the glucagon antagonist peptides described herein exhibit inhibitory activity at the glucagon receptor and/or agonist activity at the GLP-1 receptor as described above and, when the glucagon antagonist peptide is part of a conjugate (e.g., is conjugated to a heterologous moiety, e.g., a hydrophilic moiety, e.g., a polyethylene glycol), the glucagon antagonist peptide exhibits an activity that is lower (i.e. lower inhibitory potency or higher IC50) than when the glucagon antagonist peptide is not part of the conjugate. In some aspects, the glucagon antagonist peptide when not part of conjugate exhibits an inhibitory potency at the glucagon receptor that is about 10-fold or greater than the potency of the glucagon antagonist peptide when part of a conjugate. In some aspects, the glucagon antagonist peptide when unconjugated exhibits an inhibitory potency at the glucagon receptor that is about 10-fold, about 15-fold, about 20-fold, about 25-fold, about 30-fold, about 35-fold, about 40-fold, about 45-fold, about 50-fold, about 100-fold, or even greater-fold the potency of the glucagon antagonist peptide when conjugated.

Structure of the Glucagon Antagonist Peptide

In some embodiments of the present disclosures, the glucagon antagonist peptide is a glucagon antagonist, which exhibits any of the activities (potency or EC50) at the indicated receptor as described above, and is structurally similar to native human glucagon (SEQ ID NO: 1), e.g., is an analog of native human glucagon (or a glucagon analog). Such analogs of glucagon exhibiting glucagon receptor antagonist activity are known in the art. For example, glucagon antagonists in which one or more amino acids of the native human glucagon amino acid sequence were deleted or substituted include: [des His$^1$] [Glu$^9$]-glucagon amide (Unson et al., (1989) Peptides 10, 1171; Post et al., (1993) Proc. Natl. Acad. Sci. USA 90, 1662), des His$^1$, Phe$^6$ [Glu$^9$]-glucagon amide (Azizh et al., (1995) Bioorg. & Med. Chem. Lett. 16, 1849) and Nle$^9$, Ala$^{11,16}$-glucagon amide (Unson et al. (1994) J. Biol. Chem. 269(17), 12548). Other analogues include substitutions at positions 4 (Ahn J M et al. (2001) J. Pept. Res. 58(2):151-8), 1 (Dharanipragada, R. et al. (1993) Int. J. Pept. Res. 42(1): 68-77) and at position 4, 5, 12, 17 and 18 of the glucagon sequence (Gysin B et al. 1986. Biochemistry. 25(25):8278-84). Furthermore, glucagon antagonists which are structurally similar to native human glucagon are also described in International Patent Application Publication Nos. WO 2009/058662 and WO 2009/058734 and U.S. Application Nos. 60/983,783; 60/983,766; and 61/090,441; the contents of which are incorporated by reference in their entirety.

Accordingly, in some embodiments, the glucagon antagonist peptide is an analog of native human glucagon (SEQ ID NO: 1) which comprises an amino acid sequence based on SEQ ID NO: 1 but is modified with 1, 2, 3, 4, 5, 6, 7, 8, 9, 10, 11, 12, 13, 14, 15, and in some instances, 16 or more (e.g., 17, 18, 19, 20, 21, 22, 23, 24, 25, etc.) amino acid modifications. In some embodiments, the glucagon antagonist peptide comprises a total of 1, up to 2, up to 3, up to 4, up to 5, up to 6, up to 7, up to 8, up to 9, or up to 10 amino acid modifications relative to the native human glucagon sequence (SEQ ID NO: 1). In some embodiments, the modifications are any of those described herein, e.g., truncation at the N-terminus, formation into depsipeptide, substitution at position 9, acylation, alkylation, pegylation, truncation at C-terminus, substitution of the amino acid at one or more of positions 1, 2, 3, 7, 10, 12, 15, 16, 17, 18, 19, 20, 21, 23, 24, 27, 28, and 29.

In some embodiments, the glucagon antagonist peptide of the present disclosures comprises an amino acid sequence which has at least 25% sequence identity to the amino acid sequence of native human glucagon (SEQ ID NO: 1). In some embodiments, the glucagon antagonist peptide comprises an amino acid sequence which is at least 30%, at least 40%, at least 50%, at least 60%, at least 70%, at least 80%, at least 85%, at least 90% or has greater than 90% sequence identity to SEQ ID NO: 1. In some embodiments, the amino acid sequence of the glucagon antagonist peptide which has the above-referenced % sequence identity is the full-length amino acid sequence of the glucagon antagonist peptide. In some embodiments, the amino acid sequence of the glucagon antagonist peptide which has the above-referenced % sequence identity is only a portion of the amino acid sequence of the glucagon antagonist peptide. In some embodiments, the glucagon antagonist peptide comprises an amino acid sequence which has about A % or greater sequence identity to a reference amino acid sequence of at least 5 contiguous amino acids (e.g., at least 6, at least 7, at least 8, at least 9, at least 10 amino acids) of SEQ ID NO: 1, wherein the reference amino acid sequence begins with the amino acid at position C of SEQ ID NO: 1 and ends with the amino acid at position D of SEQ ID NO: 1, wherein A is 25, 30, 35, 40, 45, 50, 55, 60, 65, 70, 75, 80, 85, 90, 91, 92, 93, 94, 95, 96, 97, 98, 99; C is 1, 2, 3, 4, 5, 6, 7, 8, 9, 10, 11, 12, 13, 14, 15, 16, 17, 18, 19, 20, 21, 22, 23, 24, 25, 26, 27, or 28 and D is 5, 6, 7, 8, 9, 10, 11, 12, 13, 14, 15, 16, 17, 18, 19, 20, 21, 22, 23, 24, 25, 26, 27, 28 or 29. Any and all possible combinations of the foregoing parameters are envisioned, including but not limited to, e.g., wherein A is 90% and C and D are 1 and 27, or 6 and 27, or 8 and 27, or 10 and 27, or 12 and 27, or 16 and 27.

The GIP agonist peptides which are analogs of native human glucagon (SEQ ID NO: 1) described herein may comprise a peptide backbone of any number of amino acids, i.e., can be of any peptide length. In some embodiments, the GIP agonist peptides described herein are the same length as SEQ ID NO: 1, i.e., are 29 amino acids in length. In some embodiments, the GIP agonist peptide is longer than 29 amino acids in length, e.g., the GIP agonist peptide comprises a C-terminal extension of 1-21 amino acids, as further described herein. Accordingly, the GIP agonist peptide in some embodiments, is 30, 31, 32, 33, 34, 35, 36, 37, 38, 39, 40, 41, 42, 43, 44, 45, 46, 47, 48, 49, or 50 amino acids in length. In some embodiments, the GIP agonist peptide is longer than 29 amino acids in length (e.g., greater than 50 amino acids, (e.g., at least or about 60, at least or about 70, at least or about 80, at least or about 90, at least or about 100, at least or about 150, at least or about 200, at least or about 250, at least or about 300, at least or about 350, at least or about 400, at least or about 450, at least or about 500 amino acids in length) due to fusion with another peptide. In other embodiments, the GIP agonist peptide is less than 29 amino acids in length, e.g., 28, 27, 26, 25, 24, 23, amino acids.

In accordance with the foregoing, in some aspects, the glucagon antagonist peptide of the present disclosures is an analog of native human glucagon (SEQ ID NO: 1) comprising SEQ ID NO: 1 modified with one or more amino acid modifications which reduce or destroy glucagon activity, which increase or enhance GLP-1 activity or GIP activity, enhance stability, e.g., by reducing degradation of the peptide (e.g., by improving resistance to DPP-IV proteases), enhance solubility, increase half-life, delay the onset of action, extend the duration of action at the GIP, glucagon, or GLP-1 receptor, or a combination of any of the foregoing. Such amino acid modifications, in addition to other modifications, are further described herein.

Exemplary Embodiments of the Glucagon Antagonist Peptide

Under normal circumstances, native human glucagon activates the glucagon receptor in the human body. Described herein are modifications of the native human glucagon amino acid sequence (SEQ ID NO: 1) which alter this hormone, such that is antagonizes (e.g., binds to but does not activate downstream signaling through) the glucagon receptor.

In some embodiments of the present disclosures, the glucagon antagonist peptide comprises an amino acid sequence based on the sequence of native human glucagon (SEQ ID NO: 1) but is modified by the deletion of the first two to five amino acid residues from the N-terminus and substitution of the aspartic acid residue at position nine of the native protein (SEQ ID NO: 1) with a glutamic acid, homoglutamic acid, β-homoglutamic acid, a sulfonic acid derivative of cysteine, or an alkylcarboxylate derivative of cysteine having the structure of:

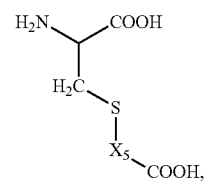

wherein $X_5$ is $C_1$-$C_4$ alkyl, $C_2$-$C_4$ alkenyl, or $C_2$-$C_4$ alkynyl.

In specific aspects, the glucagon antagonist peptide exhibiting glucagon antagonist activity and comprising the deletion of two to five amino acid residues from the N-terminus and substitution of the Asp at position 9 of the native glucagon, is further modified by up to three amino acid modifications. For example, the glucagon antagonist peptide in some aspects comprise one, two, or three conservative amino acid modifications. Alternatively or additionally, the glucagon antagonist peptide in some aspects comprises one or more amino acid modifications selected from the group consisting of:

A. substitution of one or two amino acids at positions 10, 20, and 24, (according to the amino acid numbering of SEQ ID NO: 1), or the N- or C-terminal amino acid of the glucagon antagonist with an amino acid covalently attached to an acyl group or alkyl group via an ester, ether, thioether, amide, or alkyl amine linkage;

B. substitution of one or two amino acids at positions 16, 17, 20, 21, and 24 (according to the amino acid numbering of SEQ ID NO: 1), or the N- or C-terminal amino acid of the glucagon antagonist with an amino acid selected from the group consisting of: Cys, Lys, ornithine, homocysteine, and acetyl-phenylalanine (Ac-Phe), wherein the amino acid of the group is covalently bonded to a hydrophilic moiety;

C. addition of an amino acid covalently bonded to a hydrophilic moiety to the N- or C-terminus of the glucagon antagonist;

D. substitution of Asp at position 15 (according to the numbering of SEQ ID NO: 1) with cysteic acid, glutamic acid, homoglutamic acid, and homocysteic acid;

E. substitution of Ser at position 16 (according to the numbering of SEQ ID NO: 1) with cysteic acid, glutamic acid, homoglutamic acid, and homocysteic acid;

F. substitution with AIB at one or more of positions 16, 20, 21, and 24 according to the amino acid numbering of SEQ ID NO: 1;

G. deletion of the amino acid at position 29 or the amino acids at positions 28 and 29, according to the numbering of SEQ ID NO: 1;

H. substitution of each or both of the Asn at position 28 and the Thr at position 29 (according to the amino acid numbering of SEQ ID NO: 1) with charged amino acids; and/or addition of one to two charged amino acids at the C-terminus of SEQ ID NO: 1;

I. substitution of the Met at position 27 (according to the numbering of SEQ ID NO: 1) with Leu or norleucine;

J. addition of a peptide having the amino acid sequence of any of SEQ ID NOs: 1119-1121 and 1153 to the C-terminus of SEQ ID NO: 1; wherein Thr at position 29 (according to the numbering of SEQ ID NO: 1) is Thr or Gly; and K. replacement of the C-terminal carboxylate with an amide or ester.

In specific aspects of the present disclosures, the glucagon antagonist peptide comprises an amino acid modification of A, B, or C, as described above, or a combination thereof. In yet other specific embodiments, the glucagon antagonist peptide further comprises an amino acid modification of any of D to K as described above, or a combination thereof, in addition to the amino acid modification(s) of A, B, and/or C.

In some embodiments, the glucagon antagonist peptide comprises the amino acid sequence of native human glucagon in which the first 5 amino acids have been removed from the N-terminus, and the remaining N-terminal alpha amino group has been replaced with a hydroxyl group. The N-terminal residue of these embodiments is phenyl lactic acid (PLA).

In certain aspects of the present disclosures in which the first 5 amino acids have been removed from the N-terminus, and the remaining N-terminal amino group has been replaced with a hydroxyl group, the amino acid at position 9 (according to the numbering of SEQ ID NO: 1) is modified by substituting the aspartic acid residue at position four (position 9 of the native glucagon) with an amino acid of the general structure:

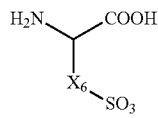

wherein $X_6$ is $C_1$-$C_3$ alkyl, $C_2$-$C_3$ alkenyl or $C_2$-$C_3$ alkynyl. In some embodiments, X is $C_1$-$C_3$ alkyl, and in other embodiments, X is $C_2$ alkyl. In some embodiments, the glucagon antagonist peptide comprises SEQ ID NO: 1 in which the first 5 amino acids have been deleted from the N-terminus, and the aspartic acid residue at position four (position 9 of the native glucagon) has been substituted with cysteic acid or homocysteic acid. However, substitution at position 9 (according to the numbering of SEQ ID NO: 1) is considered optional in embodiments in which PLA is the N-terminal residue, since the modification at position 9 is not required for antagonist activity at the glucagon receptor.

In certain aspects of the present disclosures, the glucagon antagonist peptide comprises SEQ ID NO: 1 in which the first five amino acids of the N-terminus has been deleted and the $6^{th}$ residue of SEQ ID NO: 1 (which is the $1^{st}$ amino acid of the glucagon antagonist peptide) is PLA or other phenylalanine analog, including 3, 4-2F-phenylalanine (3,4-2F-Phe), 2-naphthyalanine (2-Nal), N-acyl-phenylalanine (Ac-Phe), alpha-methylhydrocinnamic acid (MCA) and benzylmalonic acid (BMA), for example. However, as shown in WO 2009/058662, substitution with PLA at position 6 (according to the numbering of SEQ ID NO: 1) provides a more potent glucagon antagonist.

In certain aspects of the present disclosures, the glucagon antagonist peptide comprises the general structure of A-B-C, wherein A is selected from the group consisting of:
(i) phenyl lactic acid (PLA);
(ii) an oxy derivative of PLA;
(iii) a peptide of 2 to 6 amino acids in which two consecutive amino acids of the peptide are linked via an ester or ether bond;

B represents amino acids i to 26 of SEQ ID NO: 1, wherein i is 3, 4, 5, 6, or 7, optionally comprising one or more amino acid modifications selected from the group consisting of:
(iv) Asp at position 9 (according to the amino acid numbering of SEQ ID NO: 1) is substituted with a Glu, a sulfonic acid derivative of Cys, homoglutamic acid, β-homoglutamic acid, or an alkylcarboxylate derivative of cysteine having the structure of:

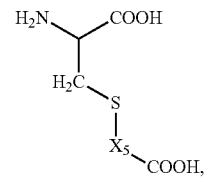

wherein $X_5$ is $C_1$-$C_4$ alkyl, $C_2$-$C_4$ alkenyl, or $C_2$-$C_4$ alkynyl.

(v) substitution of one or two amino acids at positions 10, 20, and 24, (according to the amino acid numbering of SEQ ID NO: 1) with an amino acid covalently attached to an acyl or alkyl group via an ester, ether, thioether, amide, or alkyl amine linkage;

(vi) substitution of one or two amino acids at positions 16, 17, 20, 21, and 24 (according to the amino acid numbering of SEQ ID NO: 1) with an amino acid selected from the group consisting of: Cys, Lys, ornithine, homocysteine, and acetyl-phenylalanine (Ac-Phe), wherein the amino acid of the group is covalently attached to a hydrophilic moiety;

(vii) Asp at position 15 (according to the numbering of SEQ ID NO: 1) is substituted with cysteic acid, glutamic acid, homoglutamic acid, and homocysteic acid;

(viii) Ser at position 16 (according to the numbering of SEQ ID NO: 1) is substituted with cysteic acid, glutamic acid, homoglutamic acid, and homocysteic acid;
(ix) substitution with AIB at one or more of positions 16, 20, 21, and 24 according to the amino acid numbering of SEQ ID NO: 1;
and C is selected from the group consisting of:
(x) X;
(xi) X—Y;
(xii) X—Y—Z; and
(xiii) X—Y—Z—R10,
wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid; wherein R10 is selected from a group consisting of SEQ ID NOs: 1119-1121 and 1153; and
(xiv) any of (x) to (xiii) in which the C-terminal carboxylate is replaced with an amide.

In specific aspects, the glucagon antagonist peptide comprises the general structure A-B-C as described herein and exhibits agonist activity at the GLP-1 receptor. Accordingly, in some aspects, the glucagon antagonist peptide comprises (1) a stabilized alpha helix through means described herein (e.g., through an intramolecular bridge, or incorporation of one or more alpha,alpha-di-substituted amino acids, or an acidic amino acid at position 16 (according to the numbering of SEQ ID NO:1), or a combination thereof; (2) a C-terminal amide or ester in place of a C-terminal carboxylate, and (3) a general structure of A-B-C,
wherein A is selected from the group consisting of
(i) PLA;
(ii) an oxy derivative of PLA; and
(iii) a peptide of 2 to 6 amino acids in which two consecutive amino acids of the peptide are linked via an ester or ether bond;
wherein B represents amino acids p to 26 of SEQ ID NO: 1, wherein p is 3, 4, 5, 6, or 7, optionally comprising one or more amino acid modifications selected from the group consisting of:
(iv) Asp at position 9 (according to the amino acid numbering of SEQ ID NO: 1) is substituted with a Glu, a sulfonic acid derivative of Cys, homoglutamic acid, β-homoglutamic acid, or an alkylcarboxylate derivative of cysteine having the structure of:

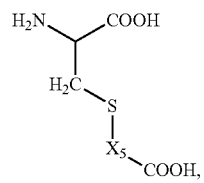

wherein $X_5$ is $C_1$-$C_4$ alkyl, $C_2$-$C_4$ alkenyl, or $C_2$-$C_4$ alkynyl;
(v) substitution of one or two amino acids at positions 10, 20, and 24, (according to the amino acid numbering of SEQ ID NO: 1) with an amino acid covalently attached to an acyl or alkyl group via an ester, ether, thioether, amide, or alkyl amine linkage;
(vi) substitution of one or two amino acids at positions 16, 17, 20, 21, and 24 (according to the amino acid numbering of SEQ ID NO: 1) with an amino acid selected from the group consisting of: Cys, Lys, ornithine, homocysteine, and acetyl-phenylalanine (Ac-Phe), wherein the amino acid of the group is covalently attached to a hydrophilic moiety;
(vii) Asp at position 15 (according to the numbering of SEQ ID NO: 1) is substituted with cysteic acid, glutamic acid, homoglutamic acid, and homocysteic acid;
(viii) Ser at position 16 (according to the numbering of SEQ ID NO: 1) is substituted with cysteic acid, glutamic acid, homoglutamic acid, and homocysteic acid;
(ix) Arg at position 17 is replaced with Gln, Arg at position 18 is replaced with Ala, Asp at position 21 is replaced with Glu, Val at position 23 is replaced with Ile, and Gln at position 24 is replaced with Ala (according to amino acid numbering of SEQ ID NO: 1);
(x) Ser at position 16 is replaced with Glu, Gln at position 20 is replaced with Glu, or Gln at position 24 is replaced with Glu(according to the amino acid numbering of SEQ ID NO: 1);
wherein C is selected from the group consisting of:
(vii) X;
(viii) X—Y;
(ix) X—Y—Z;
(x) X—Y—Z—R10;
wherein X is Met, Leu, or Nle; Y is Asn or a charged amino acid; Z is Thr, Gly, Cys, Lys, ornithine (Orn), homocysteine, acetyl phenylalanine (Ac-Phe), or a charged amino acid; wherein R10 is selected from a group consisting of SEQ ID NOs: 1221, 1226, 1227, and 1250.

In specific aspects in which the glucagon antagonist peptide comprises the general structure A-B-C, the glucagon antagonist peptide comprises an oxy derivative of PLA. As used herein "oxy derivative of PLA" refers to a compound comprising a modified structure of PLA in which the hydroxyl group has been replaced with O—$R_{11}$, wherein $R_{11}$ is a chemical moiety. In this regard, the oxy derivative of PLA can be, for example, an ester of PLA or an ether of PLA.

Methods of making oxy derivatives of PLA are known in the art. For example, when the oxy derivative is an ester of PLA, the ester may be formed by upon reaction of the hydroxyl of PLA with a carbonyl bearing a nucleophile. The nucleophile can be any suitable nucleophile, including, but not limited to an amine or hydroxyl. Accordingly, the ester of PLA can comprise the structure of Formula V:

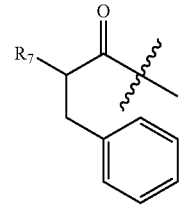

Formula V wherein R7 is an ester formed upon reaction of the hydroxyl of PLA with a carbonyl bearing a nucleophile.

The carbonyl bearing a nucleophile (which reacts with the hydroxyl of PLA to form an ester) can be, for example, a carboxylic acid, a carboxylic acid derivative, or an activated ester of a carboxylic acid. The carboxylic acid derivative can be, but is not limited to, an acyl chloride, an acid anhydride, an amide, an ester, or a nitrile. The activated ester of a carboxylic acid can be, for example, N-hydroxysuccinimide (NHS), tosylate (Tos), a carbodiimide, or a hexafluorophosphate. In some embodiments, the carbodiimide is 1,3-dicyclohexylcarbodiimide (DCC), 1,1'-carbonyldiimidazole (CDI), 1-ethyl-3-(3-dimethylaminopropyl)carbodiimide hydrochloride (EDC), or 1,3-diisopropylcarbodiimide (DICD). In some embodiments, the hexafluorophosphate is selected from a group consisting of hexafluorophosphate benzotriazol-1-yl-oxy-tris(dimethylamino)phosphonium hexafluorophosphate (BOP), benzotriazol-1-yl-oxytripyrrolidinophosphonium hexafluorophosphate (PyBOP), 2-(1H-7-azabenzotriazol-1-yl)-1,1,3,3-tetramethyl uronium hexafluorophosphate (HATU), and o-benzotriazole-N,N,N',N'-tetramethyl-uronium-hexafluoro-phosphate (HBTU).

Methods of making ethers from reaction with a hydroxyl group (e.g., the hydroxyl of PLA) also are known in the art. For example, the hydroxyl group of PLA may be reacted with a halogenated alkyl or tosylated alkyl alcohol to form an ether bond.

Generally, the chemical moiety of $R_{11}$ is one which does not decrease the activity of the glucagon antagonist peptide. In some embodiments, the chemical moiety enhances the activity, stability, and/or solubility of the glucagon antagonist peptide.

In some embodiments, the chemical moiety bound to PLA via an oxygen-containing bond (e.g., via an ester or ether bond) is a polymer (e.g., a polyalkylene glycol), a carbohydrate, an amino acid, a peptide, or a lipid, e.g., a fatty acid or a steroid.

In specific embodiments, the chemical moiety is an amino acid, which, optionally, is a part of a peptide, such that Formula V is a depsipeptide. In this regard, PLA may be at a position other than the N-terminal amino acid residue of the glucagon antagonist peptide, such that the glucagon antagonist peptide comprises one or more (e.g., 1, 2, 3, 4, 5, 6, or more) amino acids N-terminal to the PLA residue. For example, the glucagon antagonist peptide can comprise PLA at position n, wherein n is 2, 3, 4, 5, or 6 of the glucagon antagonist peptide.

The amino acids N-terminal to the PLA residue may be synthetic or naturally-occurring. In specific aspects, the amino acids which are N-terminal to PLA are naturally-occurring amino acids. In some embodiments, the amino acids which are N-terminal to PLA are the N-terminal amino acids of native glucagon. For example, the glucagon antagonist peptide can comprise at the N-terminus the amino acid sequence of any of SEQ ID NOs: 1154-1158, wherein PLA is linked to threonine via an ester bond:

```
                              SEQ ID NO: 1154
His-Ser-Gln-Gly-Thr-PLA

SEQ ID NO: 1155
Ser-Gln-Gly-Thr-PLA

SEQ ID NO: 1156
Gln-Gly-Thr-PLA

SEQ ID NO: 1157
Gly-Thr-PLA

SEQ ID NO: 1158
Thr-PLA
```

In alternative embodiments, one or more of the N-terminal amino acids may be substituted with an amino acid other than the amino acid of native glucagon. For example, when the glucagon antagonist comprises PLA as the amino acid at position 5 or 6, the amino acid at position 1 and/or position 2 may be an amino acid which reduces susceptibility to cleavage by dipeptidyl peptidase IV. More particularly, in some embodiments, position 1 of the glucagon antagonist peptide is an amino acid selected from the group consisting of D-histidine, alpha,alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the glucagon antagonist peptide is an amino acid selected from the group consisting of D-serine, D-alanine, valine, glycine, N-methyl serine, N-methyl alanine, and aminoisobutyric acid (AIB). Also, for example, when the glucagon antagonist peptide comprises PLA as the amino acid at position 4, 5, or 6, the amino acid at position 3 of the glucagon antagonist peptide may be glutamic acid, as opposed to the native glutamine residue of native glucagon. In an exemplary embodiment of the present disclosures, the glucagon antagonist comprises at the N-terminus the amino acid sequence of any of SEQ ID NOs: 1159-1161.

With respect to the glucagon antagonist peptides comprising a compound of Formula V, the polymer which is the chemical moiety bound to PLA may be any polymer, provided that it can react with the hydroxyl group of PLA. The polymer may be one that naturally or normally comprises a carbonyl bearing a nucleophile. Alternatively, the polymer may be one which was derivatized to comprise the carbonyl bearing the carbonyl. The polymer may be a derivatized polymer of any of: polyamides, polycarbonates, polyalkylenes and derivatives thereof including, polyalkylene glycols, polyalkylene oxides, polyalkylene terepthalates, polymers of acrylic and methacrylic esters, including poly(methyl methacrylate), poly(ethyl methacrylate), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

The polymer can be a biodegradable polymer, including a synthetic biodegradable polymer (e.g., polymers of lactic acid and glycolic acid, polyanhydrides, poly(ortho)esters, polyurethanes, poly(butic acid), poly(valeric acid), and poly(lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

The polymer can be a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly (octadecyl acrylate).

In some aspects, the polymer is a water-soluble polymer. Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene co-polymer, polyoxyethyleneglycols, polyethylene oxide, and derivatives, salts, and combinations thereof.

In specific embodiments, the polymer is a polyalkylene glycol, including, for example, polyethylene glycol (PEG).

In aspects in which A (of A-B-C) is an oxyderivative of PLA, the chemical moiety bound to PLA is a carbohydrate. The carbohydrate may be any carbohydrate provided that it comprises or is made to comprise a carbonyl with an alpha leaving group. The carbohydrate, for example, may be one which has been derivatized to comprise a carbonyl with an alpha leaving group. In this regard, the carbohydrate may be a derivatized form of a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

In aspects in which A (of A-B-C) is an oxyderivative of PLA, the chemical moiety bound to PLA can be a lipid. The lipid may be any lipid comprising a carbonyl with an alpha leaving group. The lipid, for example, may be one which is derivatized to comprise the carbonyl. In this regard, the lipid, may be a derivative of a fatty acid (e.g., a C4-C30 fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide oil, wax, cholesterol, sterol, fat-soluble vitamin, monoglyceride, di glyceride, triglyceride, a phospholipid.

In some embodiments, R7 has a molecular weight of about 100 kDa or less, e.g., about 90 kDa or less, about 80 kDa or less, about 70 kDa or less, about 60 kDa or less, about 50 kDa or less, about 40 kDa or less. Accordingly, R7 can have a molecular weight of about 35 kDa or less, about 30 kDa or less, about 25 kDa or less, about 20 kDa or less, about 15 kDa or less, about 10 kDa or less, about 5 kDa or less, or about 1 kDa.

In alternative embodiments, the glucagon antagonist peptide of structure A-B-C comprises, as A, a peptide of 2 to 6 amino acids in which two consecutive amino acids of the peptide are linked via an ester or ether bond. The ester or ether bond may be, e.g., between amino acids 2 and 3, 3 and 4, 4 and 5, or 5 and 6. Optionally the peptide may be further modified by covalent linkage to another chemical moiety including linkage to a polymer (e.g. a hydrophilic polymer), alkylation, or acylation.

The peptide may comprise any amino acids, synthetic or naturally occurring, provided that at least two consecutive amino acids of the peptide are linked via an ester or ether bond. In a specific embodiment, the peptide comprises amino acids of native glucagon. For example, the peptide can comprise j to 6 of native glucagon (SEQ ID NO: 1), wherein j is 1, 2, 3, 4, or 5. Alternatively, the peptide can comprise an amino acid sequence based on the N-terminus of SEQ ID NO: 1 with one or more amino acid modifications. The amino acid at position 1 and/or position 2 may be an amino acid which reduces susceptibility to cleavage by dipeptidyl peptidase IV. For instance, the peptide can comprise at position 1 of the glucagon antagonist peptide (glucagon antagonist) an amino acid selected from the group consisting of D-histidine, alpha,alpha-dimethyl imidiazole acetic acid (DMIA), N-methyl histidine, alpha-methyl histidine, imidazole acetic acid, desaminohistidine, hydroxyl-histidine, acetyl-histidine and homo-histidine. More particularly, in some embodiments, position 2 of the antagonist peptide is an amino acid selected from the group consisting of D-serine, D-alanine, valine, glycine, N-methyl serine, N-methyl alanine, and aminoisobutyric acid (AIB). Also, for example, the amino acid at position 3 of the glucagon antagonist may be glutamic acid, as opposed to the native glutamine residue of native glucagon. Accordingly, the glucagon antagonist can comprise an amino acid sequence of:

```
                                         (SEQ ID NO: 1168)
            Xaa₁-Xaa₂-Xaa₃-Thr-Gly-Phe;

(SEQ ID NO: 1169)
            Xaa₂-Xaa₃-Thr-Gly-Phe;
            or (SEQ ID NO: 1170)
            Xaa₃-Thr-Gly-Phe;
``` wherein Xaa₁ is selected from a group consisting of: His, D-histidine, alpha,alpha-dimethyl imidiazole acetic acid (DMIA), N-methyl histidine, alpha-methyl histidine, imidazole acetic acid, desaminohistidine, hydroxyl-histidine, acetyl-histidine and homo-histidine; Xaa₂ is selected from a group consisting of: Ser, D-serine, D-alanine, valine, glycine, N-methyl serine, N-methyl alanine, and aminoisobutyric acid (AIB); and Xaa₃ is Gln or Glu; wherein at least one bond between the amino acids of SEQ ID NO: 1168, 1169, or 1170 is an ester or ether bond.

With regard to the glucagon antagonist peptide comprising the general structure A-B-C, B represents amino acids of native glucagon, e.g., i to 26 of SEQ ID NO: 1, wherein i is 3, 4, 5, 6, or 7, optionally comprising one or more amino acid modifications. In a specific embodiment, B represents amino acids 7 to 26 of SEQ ID NO: 1, optionally further modified.

In some embodiments, B is modified by up to three amino acid modifications. For example, B, which represents native amino acid sequence of SEQ ID NO: 1 is modified by one or more conservative amino acid modifications.

In other embodiments, B comprises one or more amino acid modifications selected from the group consisting of (iv) to (ix), as described herein. In specific embodiments, B comprises one or both of the amino acid modifications, (v) and (vi). In further specific embodiments, B comprises one or a combination of amino acid modifications selected from the group consisting of (iv), (vii), (viii), and (ix), in addition to (v) and (vi). In a further specific embodiment in which the peptide comprises (1) a stabilized alpha helix through means described herein (e.g., through an intramolecular bridge, or incorporation of one or more alpha,alpha-di-substituted amino acids, or an acidic amino acid at position 16 (according to the numbering of SEQ ID NO:1), or a combination thereof; (2) a C-terminal amide or ester in place of a C-terminal carboxylate, and (3) a general structure of A-B-C, B comprises one or a combination of amino acid modifications selected from the group consisting of (iv), (vii), (viii), (ix), and (x), in addition to (v) and (vi).

In another specific embodiment, the glucagon antagonist peptide comprises one or more charged amino acids at the C-terminus. For example, Y and/or Z can be a charged amino acid, e.g., Lys, Arg, His, Asp, and Glu. In yet another embodiment, the glucagon antagonist peptide comprises one to two charged amino acids (e.g., Lys, Arg, His, Asp, and Glu) C-terminal to Z. In specific aspects, Z followed by one to two charged amino acids does not comprise R10. In some aspects, Y is Asp.

The glucagon antagonist peptide in some embodiments comprises a hydrophilic moiety covalently bound to an amino acid residue of the glucagon antagonist, as described herein. For example, the glucagon antagonist can comprise a hydrophilic moiety covalently attached to an amino acid at position 1, 16, 20, 21, or 24 according to the numbering of SEQ ID NO: 1 or to the N- or C-terminal amino acid of the glucagon antagonist peptide. In another embodiment, the hydrophilic moiety is attached to the C-terminal amino acid of the glucagon antagonist peptide, which in some cases, is 1 or 11 amino acids C-terminal to Z. In yet another embodiment, the hydrophilic moiety is attached to PLA, when A is PLA, PLA-Phe, or PLA-Thr-Phe, wherein PLA is modified to comprise the hydrophilic moiety. In another embodiment, an amino acid comprising a hydrophilic moiety is added to the N- or C-terminus of the glucagon antagonist.

In specific embodiments, the hydrophilic moiety is attached to a Cys residue of the glucagon antagonist peptide comprising the general structure A-B-C. In this regard, the amino acid at position 16, 21, 24, or 29 (according to the numbering of native glucagon or the N- or C-terminal amino acid may be substituted with a Cys residue. Alternatively, a Cys residue comprising a hydrophilic moiety may be added to the C-terminus of the peptide comprising the general structure A-B-C as position 30 or as position 40, e.g., when the peptide comprising the general structure A-B-C comprises a C-terminal extension (positions according to the amino acid numbering of SEQ ID NO: 1). Alternatively, the hydrophilic moiety may be attached to the PLA of the peptide comprising the general structure A-B-C via the hydroxyl moiety of PLA. The hydrophilic moiety can be any of those described herein, including, for example, polyethylene glycol.

In a specific aspect, the glucagon antagonist peptide comprising the general structure A-B-C comprises a stabilized alpha helix by virtue of comprising modifications as taught herein under "Stabilization of the Alpha Helix Structure." Accordingly, the glucagon antagonist peptide in some aspects, comprises an intramolecular bridge and/or one or more alpha,alpha di-substituted amino acids within the C-terminal portion of the peptide (residues 12-29 according to the numbering of SEQ ID NO: 1). In some aspects, a stabilized alpha helix is provided by incorporation of an intramolecular bridge into the glucagon antagonist peptide. In one embodiment, the intramolecular bridge is a lactam bridge. The lactam bridge may be between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1). In a specific embodiment, the amino acids at positions 12 and 16 or at positions 16 and 20 (according to the amino acid numbering of SEQ ID NO: 1) are linked via a lactam bridge. Other positions of the lactam bridge are contemplated.

Additionally or alternatively, the peptide comprising the general structure A-B-C can comprise a stabilized alpha helix by virtue of comprising an alpha,alpha di-substituted amino acid at, for example, any of positions 16, 20, 21, or 24 (according to the amino acid numbering of SEQ ID NO: 1). In one embodiment, the alpha,alpha di-substituted amino acid is AIB. In a specific aspect, the AIB is located at position 16 (according to the numbering of SEQ ID NO: 1).

Alternatively or additionally, the glucagon antagonist peptide comprising the general structure A-B-C may be modified to comprise an acidic amino acid at position 16 (according to the numbering of SEQ ID NO: 1), which modification enhances the stability of the alpha helix. The acidic amino acid, in one embodiment, is an amino acid comprising a side chain sulfonic acid or a side chain carboxylic acid. In a more specific embodiment, the acidic amino acid is selected from the group consisting of Glu, Asp, homoglutamic acid, a sulfonic acid derivative of Cys, cysteic acid, homocysteic acid, Asp, and an alkylated derivative of Cys having the structure of

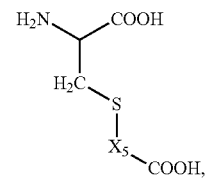

wherein $X_5$ is $C_1$-$C_4$ alkyl, $C_2$-$C_4$ alkenyl, or $C_2$-$C_4$ alkynyl.

In a specific embodiment, the glucagon antagonist peptide which is a glucagon antagonist/GLP-1 agonist may comprise the amino acid sequence of any of SEQ ID NOs: 1260-1270, 1273-1278, 1280-1288, 1290-1296, 1303, 1304, 1306, and 1314-1318, or comprising the amino acid sequence of any of Peptides 2-6 of Table A, Peptides 1-8 of Table B, and Peptides 2-6, 8, and 9 of Table C:

TABLE A

| | | | GLP-1 EC$_{50}$ (nM) | Glu IC$_{50}$ (nM) |
|---|---|---|---|---|
| 1 | E9, K12, E16 | FTSEYSKYLDERRAQDFVQWLMNTGP SSGAPPPS (SEQ ID NO: 1228) | 1451 | 762 |
| 2 | E9, K12E16(lactam) | FTSEYSKYLDERRAQDFVQWLMNTGP SSGAPPPS (SEQ ID NO: 1229) | 63 | 2008 |

TABLE A-continued

|   |   |   | GLP-1 EC$_{50}$ (nM) | Glu IC$_{50}$ (nM) |
|---|---|---|---|---|
| 3 | E9, E16K20(lactam) | FTSEYSKYLDERRAKDFVQWLMNTGPSSGAPPPS (SEQ ID NO: 1230) | 36 | 42 |
| 4 | D9, K12E16(Lactam) | FTSDYSKYLDERRAQDFVQWLMNTGPSSGAPPPS (SEQ ID NO: 1231) | 118.7 | 828 |
| 5 | [PLA6, E9, K12E16(Lactam) | PLA-TSEYSKYLDERRAQDFVQWLMNTGPSSGAPPPS (SEQ ID NO: 1232) | 6 | 72 |
| 6 | [PLA6, E9, E16K20(Lactam)] | PLA-TSEYSKYLDERRAKDFVQWLMNTGPSSGAPPPS (SEQ ID NO: 1233) | 20 | 20 |

TABLE B

|   |   | GLP-1 EC50 (nM) | Glucagon IC50 (nM) |
|---|---|---|---|
| Glucagon HSQGTFTSDYSKYlDSRRAQDFVQWLMNT (SEQ ID NO: 1) |   |   | 0.2~1.0* |
| GLP-1 (aa 1-30) HAEGTFTSDVSSYLEGQAAKEFIAWlVKGR (SEQ ID NO: 120) |   | 0.02~0.1 |   |
| 1 | [PLA6, D9, E16K20(lactam), D28]G(6-29) PLA TSDYSKYlDERRAKDFVQWLMDT (SEQ ID NO: 1276) | 5~25 | 10~30 |
| 2 | [PLA6, D9, K12E16(Lactam), D28]G(6-29) PLA TSDYSKYlDERRAQDFVQWLMDT (SEQ ID NO: 1275) | 177 | 63 |
| 3 | [PLA6, D9, E16, K20E24(Lactam), D28]G(6-29) PLA TSDYSKYLDERRAEDFVKWLMDT (SEQ ID NO: 1321) | 239 | 74 |
| 4 | [PLA6, D9, E16, E24K28(lactam), D28]G(6-29) PLA TSDYSKYLDERRAQDFVEWlMKT (SEQ ID NO: 1322) | 289 | 22 |
| 5 | [E9, E16K20(lactam), D28]G(4~29) GTFTSEYSKYLDERRAKDFVQWLMDT (SEQ ID NO: 1285) | 151 | 10~30 |
| 6 | [E9, E16K20(lactam), D28]G(2~29) SQGTFTSEYSKYlDERRAKDFVQWLMDT (SEQ ID NO: 1286) | 203 | 49 (PA) |
| 7 | [A2E3, E16K20(Lactam),D28]G(2~29) AEGTFTSEYSKYLDERRAKDEVQWLMDT (SEQ ID NO: 1281) | 175 | 63 |
| 8 | [A2E3, E16K20(Lactam), D28]G(1~29) HAEGTFTSEYSKYlDERRAKDFVQWLMDT (SEQ ID NO: 1319) | 0.2 | 130 (PA) |
| 9 | ANK2 (Bayer peptide) HSQGTFTSDY ARYLDARRAREFIKWL VRGRG (SEQ ID NO: 1323) | 0.28 | agonist |

TABLE C

| Glucagon (6-CEX) Analogs |   |   |   |
|---|---|---|---|
| 1 | E9, K12, E16 | FTSEYSKYlDERRAQDFVQWlMNTGPSSGAPPPS (SEQ ID NO: 1324) | 1451 | 762 |
| 2 | E9, K12E16(lactam) | FTSEYSKYlDERRAQDFVQWlMNTGPSSGAPPPS (SEQ ID NO: 1325) | 63 | 2008 |

TABLE C-continued

| | | | GLP-1 EC50 (nM) | Glucagon IC50 (nM) |
|---|---|---|---|---|
| 3 | E9, E16K20(lactam) | FTSEYSKY1DERRAKDFVQW1MNTGPSSGAPPPS (SEQ ID NO: 1326) | 36 | 42 |
| 4 | D9, K12E20(lactam) | FTSDYSKY1DERRAQDFVQW1MNTGPSSGAPPPS (SEQ ID NO: 1327) | 828 | |
| 5 | [PLA6, E9, K12E20(lactam) | PLA-TSEYSKY1DERRAQDFVQWLMNTGPSSGAPPPS (SEQ ID NO: 1328) | 6 | 72 |
| 6 | [PLA6, E9, E16K20(lactam) | PLA-TSEYSKYLDERRAKDFVQWLMNTGPSSGAPPPS (SEQ ID NO: 1329) | 20 | 20 |

Glucagon $D^9$(6-29) analogs

| | | | GLP-1 EC50 (nM) | Glucagon IC50 (nM) |
|---|---|---|---|---|
| 7 | PLA 6, D9, D28 | PLA-TSDYSKYLDSRRAQDFVQWLMDT (SEQ ID NO: 1330) | ~700 | tbd |
| 8 | PLA6, D9, K12E20(Lactam) | PLA-TSDYSKYLDERRAQDFVQWLMDT (SEQ ID NO: 1331) | 21 | 13 |
| 9 | PLA6, D9, E16K20(lactam) | PLA-TSDYSKYLDERRAKDFVQWLMDT (SEQ ID NO: 1332) | 4 | 6 |

In certain embodiments, the glucagon antagonist peptide comprising the general structure A-B-C is a glucagon antagonist/GLP-1 agonist which exhibits at least about 50% of the maximum agonism achieved by native GLP-1 at the GLP-1 receptor and at least about 50% inhibition of the maximum response achieved by native glucagon at the glucagon receptor. In other specific embodiments, the glucagon antagonist peptide exhibits at least about 55%, at least about 60%, at least about 70%, at least about 80%, at least about 90%, at least about 95%, or about 100% of the maximum agonism achieved by native GLP-1 at the GLP-1 receptor. Alternatively or additionally, the glucagon antagonist peptide may exhibit at least about 55%, at least about 60%, at least about 70%, at least about 80%, at least about 90%, at least about 95%, or about 100% inhibition of the maximum response achieved by native glucagon at the glucagon receptor.

In other embodiments, the glucagon antagonist peptide comprises an acyl group or alkyl group as described herein. For example, the acylation or alkylation can occur off the side chain of the amino acid at position 10, 20, or 24, according to the numbering of SEQ ID NO: 1. In an alternative embodiment, the acylation or alkylation occurs off the side chain of the C-terminal amino acid of the glucagon antagonist, which in some cases, is 1 or 11 amino acids C-terminal to Z. In yet another embodiment, when A is PLA, PLA-Phe, or PLA-Thr-Phe, the PLA is modified to comprise an acyl or alkyl group.

In certain embodiments of the present disclosures, the glucagon antagonist comprises the amino acid sequence of any of SEQ ID NOs: 1162, 1164-1167, and 1171 or structures of any of the peptides in Tables D-L.

TABLE D

| Peptide | Receptor Binding IC$_{50}$(nM) | cAMP Inhibition IC$_{50}$(nM) |
|---|---|---|
| Glucagon | 1-2.5 | N/A |
| [Glu$^9$]Glucagon(aa2-29)-NH$_2$ | 14 | partial antagonist |
| [Glu$^9$]Glucagon(aa4-29)-NH$_2$ | 136 | 128 |
| [Glu$^9$]Glucagon(aa5-29)-NH$_2$ | 37 | 74 |
| [Glu$^9$]Glucagon(aa6-29)-NH$_2$ | 36 | 97 |

Glu$^9$ is glutamic acid at position 9 according to the numbering of native glucagon.

TABLE E

| Cmpd. # | Peptide | Receptor Binding IC$_{50}$(nM) | cAMP Induction EC$_{50}$(nM) | cAMP Inhibition IC$_{50}$(nM) |
|---|---|---|---|---|
| | Glucagon | 1.75-0.31 | 0.21 ± 0.11 | N/A |
| | [desHis$^1$, Glu$^9$]Glucagon-NH$_2$ | 36.90 ± 0.32 | 65 ± 37 | 1862 ± 1234 |
| | [desHis$^1$, Glu$^9$, Phe$^{25}$, Leu$^{27}$]Glucagon-NH$_2$ | 12.59 ± 0.41 | 81 ± 23 | N/A* |
| 5 | [desHis$^1$, desPhe$^6$]Glucagon-NH$_2$ | 129.55 ± 44.9 | 1178 ± 105 | N/A* |
| 6 | [desHis$^1$, Leu$^4$, Glu$^9$]Glucagon-NH$_2$ | 36.88 ± 0.03 | 318 ± 112 | 102 ± 52 |
| 4B | [desHis$^1$, hCys$^9$(SO$_3$—), Phe$^{25}$, Leu$^{27}$]Glucagon-NH$_2$ | 13.90 ± 0.37 | 430 ± 45 | N/A* |
| 5B | [desHis$^1$, desPhe$^6$, hCys$^9$(SO$_3$—), Phe$^{25}$, Leu$^{27}$]Glucagon-NH$_2$ | 53.32 ± 9.97 | 3212 ± 368 | 9217 ± 3176 |

TABLE E-continued

| Cmpd. # | Peptide | Receptor Binding IC$_{50}$(nM) | cAMP Induction EC$_{50}$(nM) | cAMP Inhibition IC$_{50}$(nM) |
| --- | --- | --- | --- | --- |
| 6B | [desHis$^1$, Leu$^4$, hCys$^9$(SO$_3$—), Phe$^{25}$, Leu$^{27}$] Glucagon-NH$_2$ | | 1614 ± 1132 | 4456 ± 1469 |

*not an antagonist amino acid positions according to the numbering of native glucagon indicated by superscripted numbers

TABLE F

| peptide no. | peptide | residue 9 | IC$_{50}$(nM)$^a$ |
| --- | --- | --- | --- |
| | Glucagon | Asp | 1.50 (1.0~2.5)* |
| 1 | [desHis$^1$, Glu$^9$]glucagon-NH$_2$ | Glu | 14.08 ± 0.34 |
| 2 | [hGlu$^9$]Glucagon(aa2-29)-NH$_2$ | hGlu | 8.10 ± 0.40 |
| 3 | [(CSA-1)$^9$]Glucagon(aa2-29)-NH$_2$ | CSA-1 | 12.66 ± 0.13 |
| 4 | [(CSA-2)$^9$]Glucagon(aa2-29)-NH$_2$ | CSA-2 | 13.28 ± 0.78 |
| 5 | [β-hGlu$^9$]Glucagon(aa2-29)-NH$_2$ | β-hGlu | 37.10 ± 0.34 |
| 6 | [(NSG-1)$^9$]Glucagon(aa2-29)-NH$_2$ | NSG-1 | 983 ± 82 |

TABLE F-continued

| peptide no. | peptide | residue 9 | IC$_{50}$(nM)$^a$ |
|---|---|---|---|
| 7 | [(NSG-2)$^9$]Glucagon(aa2-29)-NH$_2$ | 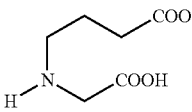 NSG-2 | 2348 ± 382 |

*EC50 (nM)

hGlu = homoglutamic acid; amino acid positions according to the numbering of native glucagon indicated by superscripted numbers

TABLE G

| peptide no. | peptide | residue 9 | IC$_{50}$(nM)$^a$ | cAMP pA$_2^b$ | (I/A)$_{50}^c$ |
|---|---|---|---|---|---|
| 8 | [Glu$^9$]Glucagon(aa4-29)-NH$_2$ | Glu | 136.0 ± 17.84 | 7.05 ± 1.01 | 1375 |
| 9 | [Leu$^4$, Glu$^9$]Glucagon(aa4-29)-NH$_2$ | Glu | 36.38 ± 8.69 | NA$^d$ | NA |
| 10 | [Glu$^9$]Glucagon(aa5-29)-NH$_2$ | Glu | 37.38 ± 3.41 | 6.94 ± 0.34 | 390 |
| 11 | [Glu$^9$]Glucagon(aa6-29)-NH$_2$ | Glu | 36.35 ± 5.23 | 7.16 ± 0.27 | 486 |
| 12 | (hGlu$^9$]Glucagon(aa6-29)-NH$_2$ | hGlu | 162.9 ± 70.8 | 6.27 ± 0.11 | 2361 |
| 13 | [(CSA-1)$^9$]Glucagon(aa6-29)-NH$_2$ | CSA-1 | 107.3 ± 5.37 | 6.68 ± 1.05 | 506 |
| 14 | [(CSA-2)$^9$]Glucagon(aa6-29)-NH$_2$ | CSA-2 | 146.4 ± 36.9 | 6.64 ± 0.29 | 580 |
| 15 | Glucagon(aa6-29)-NH$_2$ | Asp | 1894 ± 383 | 6.94 ± 0.63 | 1730 |
| 16 | [Lys$^9$]Glucagon(aa6-29)-NH$_2$ | Lys | 5779 ± 1382 | 6.58 ± 0.60 | 1990 |
| 17 | [Glu$^9$]Glucagon(aa7-29)-NH$_2$ | Glu | >10000 | ND$^e$ | ND | amino acid positions according to the numbering of native glucagon indicated by superscripted numbers $^a$Data are average ±STD for at least three independent experiments.
$^b$pA$_2$, the negative logarithm of the concentration of the antagonist that reduce the response to 1 unit of the agonist to the response obtained from 0.5 unit of agonist. Data are average ±STD for at least two duplicate experiments.
$^c$(I/A)$_{50}$, the inhibition index, the ratio of inhibitor IC$_{50}$ to the added constant glucagon (0.1-0.2 nM). Data are average of at least three independent experiments and normalized by the EC$_{50}$
$^d$NA, not full antagonist.
$^e$ND, not detected.

TABLE H

| Peptide | IC$_{50}$(nM) | pA$_2$ | cAMP IC$_{50}$(nM) |
|---|---|---|---|
| Glucagon | 1.0~2.5 (EC50) | | |
| [desHis$^1$, Glu$^9$]glucagon-NH$_2$ | 14.08 ± 0.34 | NA | 1089 (partial antagonist) |
| [hCys$^9$(SO$_3$H)]Glucagon (aa2-29)-NH$_2$ | 13.16 ± 1.0 | NA | 146.6 (partial antagonist) |
| [hCys$^9$(SO$_3$H)]Glucagon (aa4-29)-NH$_2$ | 41.55 ± 4.79 | 7.22 ± 1.09 | 68.4 |
| [hCys$^9$(SO$_3$H)]Glucagon (aa5-29)-NH$_2$ | 33.85 ± 9.38 | 6.77 ± 0.33 | 98.3 |
| [hCys$^9$(SO$_3$H)]Glucagon (aa6-29)-NH$_2$ | 59.11 ± 18.10 | 7.16 ± 0.51 | 133.4 | amino acid positions according to the numbering of native glucagon indicated by superscripted numbers

TABLE I

| Peptide | Residue 9 | IC$_{50}$(nM) receptor binding | cAMP pA$_2$ | IC$_{50}$ (nM) |
|---|---|---|---|---|
| Glucagon | Asp | 1.0~2.5 | | 0.05~0.15 (EC$_{50}$) |
| [E$^9$]Glucagon(aa6-29)-NH$_2$ | Glu | 36.35 ± 5.23 | 7.16 ± 0.27 | 97.2 |
| [hCys(SO$_3$)9]Glucagon(aa6-29)-NH$_2$ | hCys(SO$_3$) | 59.11 ± 18.10 | 7.16 ± 0.51 | 133.4 |
| [hE$^9$]Glucagon(aa6-29)-NH$_2$ | hGlu | 162.9 ± 70.8 | 6.27 ± 0.11 | 472.2 |
| [C$^9$(SCH$_2$COOH)]Glucagon(aa6-29)-NH$_2$ | CSA-1 | 107.3 ± 5.37 | 6.68 ± 1.05 | 101.2 |
| [C$^9$(SCH$_2$CH$_2$COOH)]Glucagon(aa6-29)-NH$_2$ | CSA-2 | 146.4 ± 36.9 | 6.64 ± 0.29 | 116 |
| Glucagon(aa6-29)-NH2 | Asp | 1670 ± — | 6.94 ± 0.63 | 346 |
| [K$^9$]Glucagon(aa6-29)-NH$_2$ | Lys | 3236 ± — | 6.58 ± 0.60 | 398 | amino acid positions according to the numbering of native glucagon indicated by superscripted numbers

TABLE J

| Peptide | IC50(nM) (Receptor binding) | IC50(nM) (cAMP, inhibit Glucagon) 0.1 nM or | 0.2 nM | Solubility (%, pH 6-8) |
|---|---|---|---|---|
| Glucagon | 1.96 ± 0.61 | 0.09 (EC50) | | |
| [PLA6, D9]Glucagon(aa6-29)-NH2 | 13.85 ± 3.22 | 6.90 | | 11 |
| [PLA6, D9]Glucagon(aa6-29)-COOH | 15.51 ± 3.86 | 13.20 | | 96 |
| [PLA6, E9]Glucagon(aa6-29)-NH2 | 12.33 ± 2.24 | 2.39 | 42.40 | 11 |
| [PLA6, hCys(SO3)9]Glucagon(aa6-29)-NH2 | 14.20 ± 0.45 | | 40.20 | |
| [PLA6, D9, D28]Glucagon(aa6-29)-NH2 | 9.0 ± 1.24 | 1.32 | | 100 |
| [PLA6, E9]Glucagon (aa6-29 + CEX)-NH2 | 40.28 ± 11.29 | 24.75 | | 16 | amino acid positions according to the numbering of native glucagon indicated by superscripted numbers

TABLE K

| Peptide | IC$_{50}$(nM) (Receptor binding) | IC$_{50}$(nM) (cAMP, inhibit 0.8 mM Glucagon) |
|---|---|---|
| Glucagon | 1.0-2.5 | 1.44 (EC$_{50+}$) |
| [PLA$^6$, E$^9$]Glucagon(aa6-29)-NH$_2$ | 12.34 ± 0.13 | 64.8 ± 3.4 |
| [Ac-PLA$^6$, E$^9$]Glucagon(aa6-29)-NH$_2$ | ND | 38.1 ± 9.2 |
| [PLA$^{5,}$ E$^9$]Glucagon(aa5-29)-NH$_2$ | ND | 328 ± 25 |
| [PLA$^4$, E$^9$]Glucagon(aa4-29)-NH$_2$ | ND | 84.4 ± 19.5 (partial agonist) |

ND: not detected.
amino acid positions according to the numbering of native glucagon indicated by superscripted numbers

TABLE L

| Peptide | IC50(nM) (Receptor binding) | IC50(nM) (cAMP, inhibit 0.2 mM Glucagon) |
|---|---|---|
| [C8(20 kDaPEG), E9]Glucagon(aa6-29)-NH2 | >1000 | no antagonism |
| [PLA6, C8(20 kDaPEG), E9]Glucagon (aa6-29)-NH2 | 303 ± 14 | 236 |
| [E9, C11(20 kDaPEG)]Glucagon(aa6-29)-NH2 | >1000 | no antagonism |
| [PLA6, E9, C11(20 kDaPEG)Glucagon (aa6-29)-NH2 | 776 ± 161 | 664 |
| [E9, C24(20 kDaPEG)]Glucagon(aa6-29)-NH2 | >1000 | no antagonism |
| [PLA6, E9, C24(20 kDaPEG)Glucagon (aa6-29)-NH2 | 90 ± 7 | 126 |
| [MCA6, E9, C24(20 kDaPEG)]Glucagon (aa6-29)-NH2 | 208 ± 57 | no antagonism |
| [C5(1.2 kDaPEG), E9]Glucagon(aa5-29)-NH2 | 1081 ± 268 | 2281 |
| [C5(5 kDaPEG), E9]Glucagon(aa5-29)-NH2 | 634 ± 174 | 1608 |
| [C5(20 kDaPEG), E9]Glucagon(aa5-29)-NH2 | 331 ± 74 | 976 |
| [d-Cys5(20 kDaPEG, E9]Glucagon (aa5-29)-NH2 | >10000 | 14764 |
| [K5(CH2CH2S-20 kDaPEG), E9]Glucagon (aa5-29)-NH2 | >10000 | no antagonism |
| 3.4 kDaPEG-dimer[C5, E9]Glucagon(aa5-29)-NH2 | 435 ± 256 | 1343 |
| [PLA6, C8(1.2 kDaPEG), E9]Glucagon (aa6-29)-NH2 | 220 ± 36 | no antagonism |
| [PLA6, C8(5 kDaPEG), E9]Glucagon(aa6-29)-NH2 | 948 ± 297 | 216 |
| [PLA6, C8(20 kDaPEG), E9]Glucagon (aa6-29)-NH2 | 303 ± 14 | 92 |
| [PLA6, E9, C24(1.2 kDaPEG)Glucagon (aa6-29)-NH2 | 4.7 ± 0.4 | 18 |
| [PLA6, E9, C24(20 kDaPEG)Glucagon (aa6-29)-NH2 | 90 ± 7 | 126 |
| [MCA6, E9, C24(20 kDaPEG)]Glucagon aa6-29)-NH2 | 208 ± 57 | no antagonism |
| [Phe6, E9, C24(20 kDaPEG)]Glucagon aa6-29)-NH2 | >10000 | no antagonism |

In yet other embodiments, the glucagon antagonist peptide exhibits both glucagon antagonist activity and GLP-1 agonist activity (e.g., a glucagon antagonist, GLP-1 agonist) and the glucagon antagonist peptide comprises:

(1) modifications that confer glucagon antagonist activity, including but not limited to:
  (a) substitution of the Phe at position 6 with PLA (according to amino acid numbering of wild type glucagon), optionally with deletion of 1 to 5 amino acids from the N-terminus of wild type glucagon; or
  (b) deletion of 2 to 5 amino acids from the N-terminus of wild type glucagon; optionally with substitution of Asp at position 9 of wild type glucagon with glutamic acid, homoglutamic acid or a sulfonic acid derivative of cysteine (according to amino acid numbering of wild type glucagon);
and
(2) modifications that confer GLP-1 agonist activity, including but not limited to:
  (a) insertion or substitution of α,α-disubstituted amino acid within amino acids 12-29 of wild type glucagon, e.g. at one, two, three, four or more of positions 16, 17, 18, 19, 20, 21, 24 or 29 (according to the amino acid numbering of wild type glucagon); or
  (b) introduction of an intramolecular bridge within amino acids 12-29 of wild type glucagon, e.g. a salt bridge or a lactam bridge or another type of covalent bond; or
  (c) substitution of the amino acid at one or more of positions 2, 3, 17, 18, 21, 23, or 24 (according to the amino acid numbering of native glucagon) with the corresponding amino acid of GLP-1, e.g. Ser2 is replaced with Ala, Gln3 is replaced with Glu, Arg17 is replaced with Gln, Arg at position 18 is replaced with Ala, Asp at position 21 is replaced with Glu, Val at position 23 is replaced with Ile, and/or Gln at position 24 is replaced with Ala; or (d) other modifications that stabilize the alpha-helix structure around amino acid positions 12-29 according to the amino acid numbering of wild type glucagon;

and (3) other modifications that enhance GLP-1 agonist activity, e.g.
  (a) a C-terminal amide or ester in place of a C-terminal carboxylate;

and optionally
  (4) one or more of the following modifications:
    (a) covalent attachment to a hydrophilic moiety, such as polyethylene glycol, e.g. at the N-terminus, or at position 6, 16, 17, 20, 21, 24, 29, 40 or at the C-terminal amino acid; and/or
    (b) acylation or alkylation; and optionally
  (5) one or more of the following additional modifications:
    (a) covalent linkage of amino acids, to the N-terminus, e.g. 1-5 amino acids to the N-terminus, optionally via an ester bond to PLA at position 6 (according to the numbering of wild type glucagon), optionally together with modifications at position 1 or 2, e.g. as described herein, that improve resistance to DPP-IV cleavage;
    (b) deletion of amino acids at positions 29 and/or 28, and optionally position 27 (according to the numbering of wild type glucagon);
    (c) covalent linkage of amino acids to the C-terminus;
    (d) non-conservative substitutions, conservative substitutions, additions or deletions while retaining desired activity, for example, conservative substitutions at one or more of positions 2, 5, 7, 10, 11, 12, 13, 14, 16, 17, 18, 19, 20, 21, 24, 27, 28 or 29, substitution of Tyr at position 10 with Val or Phe, substitution of Lys at position 12 with Arg, substitution of one or more of these positions with Ala;
    (e) modification of the aspartic acid at position 15, for example, by substitution with glutamic acid, homoglutamic acid, cysteic acid or homocysteic acid, which may reduce degradation; or modification of the serine at position 16, for example, by substitution of threonine, AIB, glutamic acid or with another negatively charged amino acid having a side chain with a length of 4 atoms, or alternatively with any one of glutamine, homoglutamic acid, or homocysteic acid, which likewise may reduce degradation due to cleavage of the Asp15-Ser16 bond;
    (f) modification of the methionine at position 27, for example, by substitution with leucine or norleucine, to reduce oxidative degradation;
    (g) modification of the Gln at position 20 or 24, e.g. by substitution with Ala or AIB, to reduce degradation that occurs through deamidation of Gln
    (h) modification of Asp at position 21, e.g. by substitution with Glu, to reduce degradation that occurs through dehydration of Asp to form a cyclic succinimide intermediate followed by isomerization to iso-aspartate;
    (j) homodimerization or heterodimerization as described herein; and
    (k) combinations of the above.

It is understood that any of the modifications within the same class may be combined together and/or modifications of different classes are combined. For example, the modifications of (1)(a) may be combined with (2)(a) and (3); (1)(a) may be combined with (2)(b), e.g. lactam bridge or salt bridge, and (3); (1)(a) may be combined with (2)(c) and (3); (1)(b) may be combined with (2)(a) and (3); (1)(b) may be combined with (2)(b), e.g. lactam bridge or salt bridge, and (3); (1)(b) may be combined with (2)(c) and (3); any of the foregoing may be combined with (4)(a) and/or (4)(b); and any of the foregoing may be combined with any of (5)(a) through (5)(k).

In exemplary embodiments, the α,α-disubstituted amino acid AIB is substituted at one, two, three or all of positions 16, 20, 21, or 24 (according to the amino acid numbering of wild type glucagon).

In exemplary embodiments, the intramolecular bridge is a salt bridge.

In other exemplary embodiments, the intramolecular bridge is a covalent bond, e.g. a lactam bridge. In some embodiments, the lactam bridge is between the amino acids at positions 9 and 12, the amino acids at positions 12 and 16, the amino acids at positions 16 and 20, the amino acids at positions 20 and 24, or the amino acids at positions 24 and 28 (according to the amino acid numbering of SEQ ID NO: 1).

In exemplary embodiments, acylation or alkylation is at position 6, 10, 20 or 24 or the N-terminus or C-terminus (according to the amino acid numbering of wild type glucagon) SEQ ID NO: 1).

In exemplary embodiments, modifications include:
  (i) substitution of Asp at position 15 (according to the numbering of SEQ ID NO: 1) with cysteic acid, glutamic acid, homoglutamic acid, and homocysteic acid;
  (ii) substitution of Ser at position 16 (according to the numbering of SEQ ID NO: 1) with cysteic acid, glutamic acid, homoglutamic acid, and homocysteic acid;
  (iii) substitution of Asn at position 28 with a charged amino acid;
  (iv) substitution of Asn at position 28 with a charged amino acid selected from the group consisting of Lys, Arg, His, Asp, Glu, cysteic acid, and homocysteic acid;
  (v) substitution at position 28 with Asn, Asp, or Glu;
  (vi) substitution at position 28 with Asp;
  (vii) substitution at position 28 with Glu;
  (viii) substitution of Thr at position 29 with a charged amino acid;
  (ix) substitution of Thr at position 29 with a charged amino acid selected from the group consisting of Lys, Arg, His, Asp, Glu, cysteic acid, and homocysteic acid;
  (x) substitution at position 29 with Asp, Glu, or Lys;
  (xi) substitution at position 29 with Glu;
  (xii) insertion of 1-3 charged amino acids after position 29;
  (xiii) insertion after position 29 of Glu or Lys;
  (xiv) insertion after position 29 of Gly-Lys or Lys-Lys;
  or combinations thereof.

Additional Modifications of the Glucagon Antagonist Peptide

In some aspects of the present disclosures, the glucagon antagonist peptide of any of the foregoing embodiments (e.g., the glucagon antagonist peptide of structure A-B-C, the glucagon antagonist peptide comprising a deletion of amino acids 1-5 of SEQ ID NO: 1 and a PLA at position 6 in place of Phe of SEQ ID NO: 1, the glucagon antagonist peptide comprising a substitution at position 9 and a deletion of N-terminal residues of SEQ ID NO: 1) comprises one or more further amino acid modifications (as compared to SEQ ID NO: 1), such as any of the amino acid modifications taught herein within the sections entitled "Modifications which reduce degradation," "Modifications which enhance solubility," "Other modifications," "Acylation and alkylation." While these teachings are made in the context of the GIP agonist peptide, such modifications are applicable to the glucagon antagonist peptide of the present disclosures. It should be understood that the numbering of amino acid positions of these sections are in accordance with the numbering of SEQ ID NO: 1.

Accordingly, in some aspects, the glucagon antagonist peptide comprises an amino acid modification which reduces degradation. In exemplary aspects, the glucagon antagonist peptide comprises modifications which provide glucagon antagonist activity and further comprises one or two amino acid modifications at position 15 and/or position 16, as described herein with respect to the GIP agonist peptide. See, "Modifications that reduce degradation." Accordingly, in some aspects, the glucagon antagonist peptide comprises any of the modifications which confer glucagon antagonist activity and further comprises a substitution of the aspartic acid located at position 15 of the native glucagon peptide with an amino acid selected from the group consisting of cysteic acid, glutamic acid, homoglutamic acid and homocysteic acid.

In accordance with some embodiments, the glucagon antagonist peptide comprises any of the modifications which confer glucagon antagonist activity and further comprises a substitution of the serine at position 16 (according to the numbering of native glucagon) with glutamic acid, cysteic acid, homo-glutamic acid, or homo-cysteic acid. In a specific embodiment, the serine at position 16 (according to the native glucagon sequence numbering) is replaced with glutamic acid. In a more specific aspect, the glucagon antagonist comprising such a modification comprises a C-terminal carboxylate and is not amidated.

In some aspects, the glucagon antagonist peptide comprises any of the modifications which confer glucagon antagonist activity and further comprises a substitution of the Met at position 27 (according to the numbering of SEQ ID NO: 1) with a Leu or norleucine to prevent oxidative degradation of the peptide.

In some aspects, the glucagon antagonist peptide comprises any of the modifications which confer glucagon antagonist activity and further comprises a substitution of any of the Gln at position 20, the Asp at position 21, or the Gln at position 24 (or a combination thereof) (positions according to the numbering of SEQ ID NO: 1) with another amino acid, as described herein with regard to the GIP agonist peptide. In some aspects, the amino acid at position 20 and/or 24 (according to the numbering of SEQ ID NO: 1) is substituted with Ser, Thr, Ala, or AIB. In other embodiments, the amino acid at position 20 and/or 24 (according to the numbering of SEQ ID NO: 1) is substituted with Lys, Arg, Orn, or citrulline. In some embodiments, the amino acid at position 21 (according to the numbering of SEQ ID NO: 1) is substituted with Glu.

In yet other aspects of the present disclosures, the glucagon antagonist peptide is modified for enhanced solubility. For example, the glucagon antagonist peptide can be modified in accordance with the teachings under "Modifications that enhance solubility" taught herein. In exemplary embodiments, the glucagon antagonist peptide comprises one or two charged amino acids at positions 28 and 29 (according to the numbering of SEQ ID NO: 1) and/or comprises additional charged amino acids C-terminal to position 29 (according to the numbering of SEQ ID NO: 1).

The glucagon antagonist peptide in additional aspects comprises any of the modifications taught herein under "Other modifications." For example, the glucagon antagonist peptide in some aspects comprises a substitution of Lys at position 12 (according to the numbering of SEQ ID NO: 1) with Arg. In some aspects, the glucagon antagonist peptide comprises a charge neutral group in place of the alpha carboxylate of the C-terminal residue.

In some embodiments, the glucagon antagonist peptide which exhibits glucagon antagonist activity is acylated or alkylated in accordance with the teachings found herein under "Acylation and alkylation."

Any of the modifications described above which increase GLP-1 receptor agonist activity, glucagon receptor antagonist activity, peptide solubility, and/or peptide stability can be applied individually or in combination.

Glucagon Analog Peptides

In addition to the peptide combinations comprising a GIP agonist peptide and a glucagon antagonist peptide, the present disclosures additionally provide any of the glucagon analog peptides described herein (e.g., the GIP agonist peptides, glucagon antagonist peptides) in free form (e.g., not in combination with a different type of peptide, not conjugated to another peptide), provided that they are not disclosed in any of the references cited herein, including any of International Patent Application No. PCT/US2009/47447, International Patent Application Publication Nos. WO2009/058662 and WO2009/058734, or U.S. Patent Application Nos. 60/073,274; 61/078,171; 61/090,448; 61/151,349; 61/187,578; 60/983,783; 60/983,766; 61/090,441. Accordingly, in exemplary embodiments, the glucagon analog peptide is a GIP agonist peptide not in combination with (e.g., not conjugated to) a glucagon antagonist peptide. In alternative embodiments, the glucagon analog peptide is a glucagon antagonist peptide, not in combination with (e.g., not conjugated to) a GIP agonist peptide.

In some embodiments, the peptide of the present disclosures is either a GIP agonist peptide or a glucagon antagonist peptide, according to the descriptions herein, is an analog of glucagon (SEQ ID NO: 1), and furthermore is an analog of a peptide disclosed in any of the references cited herein, including any of International Patent Application No. PCT/US2009/47447, International Patent Application Publication Nos. WO2009/058662 and WO2009/058734, or U.S. Patent Application Nos. 60/073,274; 61/078,171; 61/090,448; 61/151,349; 61/187,578; 60/983,783; 60/983,766; 61/090,441, in which one or more amino acid residues of the analog cited in these references is changed in accordance with the teachings described herein. For example, the glucagon analog peptide of the present disclosures may be an analog of an amino acid sequence found within Sequence Listing 2 or Sequence Listing 3 in which the sequence begins with a Tyr, wherein the analog comprises an amino acid modification which reduces GIP activity as described herein. For example, the analog may be identical in sequence to a sequence of Sequence Listing 2 or 3, but comprises instead of the Tyr at position 1, a small aliphatic residue, e.g., Ala, Gly, or has the amino acid(s) at position 1 or at positions 1 and 2 deleted.

In some embodiments, in which the glucagon analog peptide is a GIP agonist peptide, the glucagon analog peptide can exhibit activity at the glucagon receptor in addition to activity at the GIP receptor (and, optionally, the GLP-1 receptor). In exemplary embodiments, the GIP agonist peptide exhibits tri-agonism at each of the glucagon, GIP, and GLP-1 receptors or co-agonism at each of the glucagon and GIP receptors. In such embodiments, the glucagon analog peptide exhibits at least or about 0.1% activity of native glucagon at the glucagon receptor. In exemplary embodiments, the GIP agonist peptide exhibits at least or about 0.2%, at least or about 0.3%, at least or about 0.4%, at least or about 0.5%, at least or about 0.6%, at least or about 0.7%, at least or about 0.8%, at least or about 0.9%, at least or about 1%, at least or about 5%, at least or about 10%, at least or about 20%, at least or about 30%, at least or about 40%, at least or about 50%, at least or about 60%, at least or about 70%, at least or about 75%, at least or about 80%, at least or about 90%, at least or about 95%, or at least or about 100% of the activity of native glucagon at the glucagon receptor.

In some embodiments, the EC50 of the GIP agonist peptide at the GIP receptor is less than or about 50-fold, less than or about 40-fold, less than or about 30-fold, or less than or about 20-fold different (higher or lower) from its EC50 at the glucagon receptor. In some embodiments, the GIP potency of the GIP agonist peptide is less than or about 25-, 20-, 15-, 10-, or 5-fold different (higher or lower) from its glucagon potency. In some embodiments, the ratio of the EC50 of the GIP agonist peptide at the GIP receptor divided by the EC50 of the GIP agonist peptide at the glucagon receptor is less than about 100, 75, 60, 50, 40, 30, 20, 15, 10, or 5, and no less than 1. In some embodiments, the ratio of the GIP potency of the GIP agonist peptide compared to the glucagon potency of the GIP agonist peptide is less than about 100, 75, 60, 50, 40, 30, 20, 15, 10, or 5, and no less than 1. In some embodiments, the ratio of the EC50 of the GIP agonist peptide at the glucagon receptor divided by the EC50 of the GIP agonist peptide at the GIP receptor is less than about 100, 75, 60, 50, 40, 30, 20, 15, 10, or 5, and no less than 1. In some embodiments, the ratio of the glucagon potency of the GIP agonist peptide compared to the GIP potency of the GIP agonist peptide is less than about 100, 75, 60, 50, 40, 30, 20, 15, 10, or 5, and no less than 1.

In some embodiments in which the glucagon analog peptide is a GIP agonist peptide and the GIP agonist peptide is exhibits agonism at the GIP and GLP-1 receptors, the selectivity for the human GLP-1 receptor of the GIP agonist peptide is not at least 100-fold the selectivity of for the human GIP receptor. In exemplary embodiments, the selectivity of the GIP agonist peptide for the human GLP-1 receptor versus the GIP receptor is less than 100-fold (e.g., less than or about 90-fold, less than or about 80-fold, less than or about 70-fold, less than or about 60-fold, less than or about 50-fold, less than or about 40-fold, less than or about 30-fold, less than or about 20-fold, less than or about 10-fold, less than or about 5-fold).

In some embodiments, the peptides described herein are glycosylated, amidated, carboxylated, phosphorylated, esterified, N-acylated, cyclized via, e.g., a disulfide bridge, or converted into a salt (e.g., an acid addition salt, a basic addition salt), and/or optionally dimerized, multimerized, or polymerized, or conjugated.

The peptides of the disclosure can be obtained by methods known in the art. Suitable methods of de novo synthesizing peptides are described in, for example, Chan et al., Fmoc Solid Phase Peptide Synthesis, Oxford University Press, Oxford, United Kingdom, 2005; Peptide and Protein Drug Analysis, ed. Reid, R., Marcel Dekker, Inc., 2000; Epitope Mapping, ed. Westwood et al., Oxford University Press, Oxford, United Kingdom, 2000; and U.S. Pat. No. 5,449,752.

Also, in the instances in which the peptides of the disclosure do not comprise any non-coded or non-natural amino acids, the peptide can be recombinantly produced using a nucleic acid encoding the amino acid sequence of the analog using standard recombinant methods. See, for instance, Sambrook et al., Molecular Cloning: A Laboratory Manual. 3rd ed., Cold Spring Harbor Press, Cold Spring Harbor, N.Y. 2001; and Ausubel et al., Current Protocols in Molecular Biology, Greene Publishing Associates and John Wiley & Sons, NY, 1994.

In some embodiments, the peptides of the disclosure are isolated. In some embodiments, the peptides of the disclosure are purified. It is recognized that "purity" is a relative term, and not to be necessarily construed as absolute purity or absolute enrichment or absolute selection. In some aspects, the purity is at least or about 50%, is at least or about 60%, at least or about 70%, at least or about 80%, or at least or about 90% (e.g., at least or about 91%, at least or about 92%, at least or about 93%, at least or about 94%, at least or about 95%, at least or about 96%, at least or about 97%, at least or about 98%, at least or about 99% or is approximately 100%.

In some embodiments, the peptides described herein are commercially synthesized by companies, such as Synpep (Dublin, Calif.), Peptide Technologies Corp. (Gaithersburg, Md.), and Multiple Peptide Systems (San Diego, Calif.). In this respect, the peptides can be synthetic, recombinant, isolated, and/or purified.

The present disclosures further provides conjugates and pharmaceutical compositions comprising the peptide. The teachings under "Conjugates" and "Compositions, Pharmaceutical compositions" are applicable to these embodiments.

The present disclosures further provides methods of using the peptides which are glucagon analogs and are either GIP agonist peptides or glucagon antagonist peptides. When the peptide is a GIP agonist peptide, the peptide may be used in any of the methods of treatment described herein, including methods of treating a metabolic disorder, e.g., diabetes, obesity, and the like. When the peptide is a glucagon antagonist, the peptide may be used in a method of treating hypoglycemia, or in any method described in the teachings of International Patent Application Publication Nos. WO2009/058734 and WO2009/058662.

Conjugates

The present disclosures further provide conjugates. In some aspects, the conjugate comprises a GIP agonist conjugated to a glucagon antagonist peptide. In some aspects, the conjugate comprises at least one of the GIP agonist peptide and the glucagon antagonist peptide conjugated to a heterologous moiety. In some aspects, the conjugate comprises a GIP agonist conjugated to a glucagon antagonist peptide and at least one of the peptides is conjugated to a heterologous moiety.

The conjugation between the two peptides or between the peptide and heterologous moiety may involve covalent bonds, non-covalent bonds, or both types of bonds. In some aspects, the covalent bonds are any of the covalent linkages described herein (e.g., disulfide bonds, lactam bridges, olefin metathesis, and the like). In some aspects, the covalent bonds are peptide bonds. In specific embodiments in which the conjugation involves peptide bonds, the conjugate may be a fusion peptide comprising either or both of the GIP agonist peptide and the glucagon antagonist peptide and optionally a heterologous moiety, e.g., a Fc receptor, or portion thereof.

In alternative embodiments, the GIP agonist peptide is conjugated to the glucagon antagonist peptide through non-covalent linkages, e.g., electrostatic interactions, hydrogen bonds, van der Waals interactions, salt bridges, hydrophobic interactions, and the like.

The conjugation of the peptide to the other peptide and/or to the heterologous moiety may be indirect or direct conjugation, the former of which may involve a linker or spacer. Suitable linkers and spacers are known in the art and include, but not limited to, any of the linkers or spacers described herein under the sections "Acylation and alkylation" and "Linkages."

Heterologous Moieties

As used herein, the term "heterologous moiety" is synonymous with the term "conjugate moiety" and refers to any molecule (chemical or biochemical, naturally-occurring or non-coded) which is different from the GIP agonist peptide or glucagon antagonist peptide to which it is attached. Exemplary conjugate moieties that can be linked to any of the analogs described herein include but are not limited to a heterologous peptide or polypeptide (including for example, a plasma protein), a targeting agent, an immunoglobulin or portion thereof (e.g., variable region, CDR, or Fc region), a diagnostic label such as a radioisotope, fluorophore or enzymatic label, a polymer including water soluble polymers, or other therapeutic or diagnostic agents. In some embodiments a conjugate is provided comprising a peptide of the peptide combination and a plasma protein, wherein the plasma protein is selected from the group consisting of albumin, transferin, fibrinogen and globulins. In some embodiments the plasma protein moiety of the conjugate is albumin or transferin. The conjugate in some embodiments comprises one or more of the peptides of the peptide combinations described herein and one or more of: a peptide (which is distinct from the GIP agonist peptide and glucagon antagonist peptide described herein), a polypeptide, a nucleic acid molecule, an antibody or fragment thereof, a polymer, a quantum dot, a small molecule, a toxin, a diagnostic agent, a carbohydrate, an amino acid.

In some embodiments, the heterologous moiety is a peptide which is distinct from the GIP agonist peptide and glucagon antagonist peptide described herein and the conjugate is a fusion peptide or a chimeric peptide. In some embodiments, the heterologous moiety is a peptide extension of 1-21 amino acids. In specific embodiments, the extension is attached to the C-terminus of the glucagon analog, e.g., to amino acid at position 29. In some embodiments, the extension comprises an amino acid sequence of SEQ ID NO: 3 (GPSSGAPPPS), SEQ ID NO: 4 (GGPSSGAPPPS), SEQ ID NO: 8 (KRNRNNIA), or SEQ ID NO: 9 (KRNR). In specific aspects, the amino acid sequence is attached through the C-terminal amino acid of the peptide, e.g., amino acid at position 29. In some embodiments, the amino acid sequence of SEQ ID NOs: 3, 4, 8, and 9 is bound to amino acid 29 of the peptide through a peptide bond. In some specific embodiments, the amino acid at position 29 of the glucagon analog is a Gly and the Gly is fused to one of the amino acid sequences of SEQ ID NOs: 3, 4, 8, and 9.

In some embodiments, the heterologous moiety is a polymer. In some embodiments, the polymer is selected from the group consisting of: polyamides, polycarbonates, polyalkylenes and derivatives thereof including, polyalkylene glycols, polyalkylene oxides, polyalkylene terephthalates, polymers of acrylic and methacrylic esters, including poly(methyl methacrylate), poly(ethyl methacrylate), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene.

In some aspects, the polymer is a biodegradable polymer, including a synthetic biodegradable polymer (e.g., polymers of lactic acid and glycolic acid, polyanhydrides, poly(ortho) esters, polyurethanes, poly(butic acid), poly(valeric acid), and poly(lactide-cocaprolactone)), and a natural biodegradable polymer (e.g., alginate and other polysaccharides including dextran and cellulose, collagen, chemical derivatives thereof (substitutions, additions of chemical groups, for example, alkyl, alkylene, hydroxylations, oxidations, and other modifications routinely made by those skilled in the art), albumin and other hydrophilic proteins (e.g., zein and other prolamines and hydrophobic proteins)), as well as any copolymer or mixture thereof. In general, these materials degrade either by enzymatic hydrolysis or exposure to water in vivo, by surface or bulk erosion.

In some aspects, the polymer is a bioadhesive polymer, such as a bioerodible hydrogel described by H. S. Sawhney, C. P. Pathak and J. A. Hubbell in Macromolecules, 1993, 26, 581-587, the teachings of which are incorporated herein, polyhyaluronic acids, casein, gelatin, glutin, polyanhydrides, polyacrylic acid, alginate, chitosan, poly(methyl methacrylates), poly(ethyl methacrylates), poly(butylmethacrylate), poly(isobutyl methacrylate), poly(hexylmethacrylate), poly(isodecyl methacrylate), poly(lauryl methacrylate), poly(phenyl methacrylate), poly(methyl acrylate), poly(isopropyl acrylate), poly(isobutyl acrylate), and poly(octadecyl acrylate).

In some embodiments, the polymer is a water-soluble polymer or a hydrophilic polymer. Hydrophilic polymers are further described herein under "Hydrophilic Moieties." Suitable water-soluble polymers are known in the art and include, for example, polyvinylpyrrolidone, hydroxypropyl cellulose (HPC; Klucel), hydroxypropyl methylcellulose (HPMC; Methocel), nitrocellulose, hydroxypropyl ethylcellulose, hydroxypropyl butylcellulose, hydroxypropyl pentylcellulose, methyl cellulose, ethylcellulose (Ethocel), hydroxyethyl cellulose, various alkyl celluloses and hydroxyalkyl celluloses, various cellulose ethers, cellulose acetate, carboxymethyl cellulose, sodium carboxymethyl cellulose, calcium carboxymethyl cellulose, vinyl acetate/crotonic acid copolymers, poly-hydroxyalkyl methacrylate, hydroxymethyl methacrylate, methacrylic acid copolymers, polymethacrylic acid, polymethylmethacrylate, maleic anhydride/methyl vinyl ether copolymers, poly vinyl alcohol, sodium and calcium polyacrylic acid, polyacrylic acid, acidic carboxy polymers, carboxypolymethylene, carboxyvinyl polymers, polyoxyethylene polyoxypropylene copolymer, polymethylvinylether co-maleic anhydride, carboxymethylamide, potassium methacrylate divinylbenzene co-polymer, polyoxyethyleneglycols, polyethylene oxide, and derivatives, salts, and combinations thereof.

In specific embodiments, the polymer is a polyalkylene glycol, including, for example, polyethylene glycol (PEG).

In some embodiments, the heterologous moiety is a carbohydrate. In some embodiments, the carbohydrate is a monosaccharide (e.g., glucose, galactose, fructose), a disaccharide (e.g., sucrose, lactose, maltose), an oligosaccharide (e.g., raffinose, stachyose), a polysaccharide (a starch, amylase, amylopectin, cellulose, chitin, callose, laminarin, xylan, mannan, fucoidan, galactomannan.

In some embodiments, the heterologous moiety is a lipid. The lipid, in some embodiments, is a fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide, oil, wax, cholesterol, sterol, fat-soluble vitamin, monoglyceride, diglyceride, triglyceride, a phospholipid.

Fc Fusions

As noted above, in some embodiments, the peptides are conjugated, e.g., fused to an immunoglobulin or portion thereof (e.g., variable region, CDR, or Fc region). Known types of immunoglobulins (Ig) include IgG, IgA, IgE, IgD or IgM. The Fc region is a C-terminal region of an Ig heavy chain, which is responsible for binding to Fc receptors that carry out activities such as recycling (which results in prolonged half-life), antibody dependent cell-mediated cytotoxicity (ADCC), and complement dependent cytotoxicity (CDC).

For example, according to some definitions the human IgG heavy chain Fc region stretches from Cys226 to the C-terminus of the heavy chain. The "hinge region" generally extends from Glu216 to Pro230 of human IgG1 (hinge regions of other IgG isotypes may be aligned with the IgG1 sequence by aligning the cysteines involved in cysteine bonding). The Fc region of an IgG includes two constant domains, CH2 and CH3. The CH2 domain of a human IgG Fc region usually extends from amino acids 231 to amino acid 341. The CH3 domain of a human IgG Fc region usually extends from amino acids 342 to 447. References made to amino acid numbering of immunoglobulins or immunoglobulin fragments, or regions, are all based on Kabat et al. 1991, Sequences of Proteins of Immunological Interest, U.S. Department of Public Health, Bethesda, Md. In a related embodiments, the Fc region may comprise one or more native or modified constant regions from an immunoglobulin heavy chain, other than CH1, for example, the CH2 and CH3 regions of IgG and IgA, or the CH3 and CH4 regions of IgE.

Suitable conjugate moieties include portions of immunoglobulin sequence that include the FcRn binding site. FcRn, a salvage receptor, is responsible for recycling immunoglobulins and returning them to circulation in blood. The region of the Fc portion of IgG that binds to the FcRn receptor has been described based on X-ray crystallography (Burmeister et al. 1994, Nature 372:379). The major contact area of the Fc with the FcRn is near the junction of the CH2 and CH3 domains. Fc-FcRn contacts are all within a single Ig heavy chain. The major contact sites include amino acid residues 248, 250-257, 272, 285, 288, 290-291, 308-311, and 314 of the CH2 domain and amino acid residues 385-387, 428, and 433-436 of the CH3 domain.

Some conjugate moieties may or may not include FcγR binding site(s). FcγR are responsible for ADCC and CDC. Examples of positions within the Fc region that make a direct contact with FcγR are amino acids 234-239 (lower hinge region), amino acids 265-269 (B/C loop), amino acids 297-299 (C'/E loop), and amino acids 327-332 (F/G) loop (Sondermann et al., Nature 406: 267-273, 2000). The lower hinge region of IgE has also been implicated in the FcRI binding (Henry, et al., Biochemistry 36, 15568-15578, 1997). Residues involved in IgA receptor binding are described in Lewis et al., (J. Immunol. 175:6694-701, 2005). Amino acid residues involved in IgE receptor binding are described in Sayers et al. (J Biol. Chem. 279(34):35320-5, 2004).

Amino acid modifications may be made to the Fc region of an immunoglobulin. Such variant Fc regions comprise at least one amino acid modification in the CH3 domain of the Fc region (residues 342-447) and/or at least one amino acid modification in the CH2 domain of the Fc region (residues 231-341). Mutations believed to impart an increased affinity for FcRn include T256A, T307A, E380A, and N434A (Shields et al. 2001, J. Biol. Chem. 276:6591). Other mutations may reduce binding of the Fc region to FcγRI, FcγRIIA, FcγRIIB, and/or FcγRIIIA without significantly reducing affinity for FcRn. For example, substitution of the Asn at position 297 of the Fc region with Ala or another amino acid removes a highly conserved N-glycosylation site and may result in reduced immunogenicity with concomitant prolonged half-life of the Fc region, as well as reduced binding to FcγRs (Routledge et al. 1995, Transplantation 60:847; Friend et al. 1999, Transplantation 68:1632; Shields et al. 1995, J. Biol. Chem. 276:6591). Amino acid modifications at positions 233-236 of IgG1 have been made that reduce binding to FcγRs (Ward and Ghetie 1995, Therapeutic Immunology 2:77 and Armour et al. 1999, Eur. J. Immunol. 29:2613). Some exemplary amino acid substitutions are described in U.S. Pat. Nos. 7,355,008 and 7,381, 408, each incorporated by reference herein in its entirety.

Hydrophilic Moieties

The GIP agonist peptide and/or glucagon antagonist peptide described herein can be further modified to improve its solubility and stability in aqueous solutions at physiological pH, while retaining the high biological activity relative to native glucagon. Hydrophilic moieties such as PEG groups can be attached to the analogs under any suitable conditions used to react a protein with an activated polymer molecule. Any means known in the art can be used, including via acylation, reductive alkylation, Michael addition, thiol alkylation or other chemoselective conjugation/ligation methods through a reactive group on the PEG moiety (e.g., an aldehyde, amino, ester, thiol, α-haloacetyl, maleimido or hydrazino group) to a reactive group on the target compound (e.g., an aldehyde, amino, ester, thiol, α-haloacetyl, maleimido or hydrazino group). Activating groups which can be used to link the water soluble polymer to one or more proteins include without limitation sulfone, maleimide, sulfhydryl, thiol, triflate, tresylate, azidirine, oxirane, 5-pyridyl, and alpha-halogenated acyl group (e.g., alpha-iodo acetic acid, alpha-bromoacetic acid, alpha-chloroacetic acid). If attached to the analog by reductive alkylation, the polymer selected should have a single reactive aldehyde so that the degree of polymerization is controlled. See, for example, Kinstler et al., *Adv. Drug. Delivery Rev.* 54: 477-485 (2002); Roberts et al., *Adv. Drug Delivery Rev.* 54: 459-476 (2002); and Zalipsky et al., *Adv. Drug Delivery Rev.* 16: 157-182 (1995).

In specific aspects, an amino acid residue of the analog having a thiol is modified with a hydrophilic moiety such as PEG. In some embodiments, the thiol is modified with maleimide-activated PEG in a Michael addition reaction to result in a PEGylated analog comprising the thioether linkage shown below:

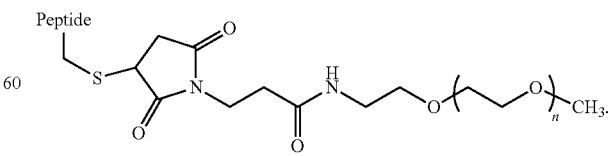

In some embodiments, the thiol is modified with a haloacetyl-activated PEG in a nucleophilic substitution reaction to result in a PEGylated analog comprising the thioether linkage shown below:

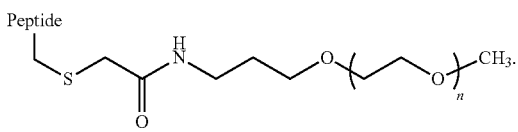

Suitable hydrophilic moieties include polyethylene glycol (PEG), polypropylene glycol, polyoxyethylated polyols (e.g., POG), polyoxyethylated sorbitol, polyoxyethylated glucose, polyoxyethylated glycerol (POG), polyoxyalkylenes, polyethylene glycol propionaldehyde, copolymers of ethylene glycol/propylene glycol, monomethoxy-polyethylene glycol, mono-(C1-C10) alkoxy- or aryloxy-polyethylene glycol, carboxymethylcellulose, polyacetals, polyvinyl alcohol (PVA), polyvinyl pyrrolidone, poly-1, 3-dioxolane, poly-1,3,6-trioxane, ethylene/maleic anhydride copolymer, poly (.beta.-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, colonic acids or other polysaccharide polymers, Ficoll or dextran and mixtures thereof. Dextrans are polysaccharide polymers of glucose subunits, predominantly linked by α1-6 linkages. Dextran is available in many molecular weight ranges, e.g., about 1 kD to about 100 kD, or from about 5, 10, 15 or 20 kD to about 20, 30, 40, 50, 60, 70, 80 or 90 kD. Linear or branched polymers are contemplated. Resulting preparations of conjugates may be essentially monodisperse or polydisperse, and may have about 0.5, 0.7, 1, 1.2, 1.5 or 2 polymer moieties per analog.

In some embodiments, the peptide of the conjugate is conjugated to a hydrophilic moiety via covalent linkage between a side chain of an amino acid of the glucagon analog and the hydrophilic moiety. In some embodiments, the glucagon analog is conjugated to a hydrophilic moiety via the side chain of an amino acid at position 16, 17, 21, 24, or 29, a position within a C-terminal extension, or the C-terminal amino acid, or a combination of these positions. In some aspects, the amino acid covalently linked to a hydrophilic moiety (e.g., the amino acid comprising a hydrophilic moiety) is a Cys, Lys, Orn, homo-Cys, or Ac-Phe, and the side chain of the amino acid is covalently bonded to a hydrophilic moiety (e.g., PEG).

rPEG

In some embodiments, the conjugate of the present disclosures comprises the peptide fused to an accessory analog which is capable of forming an extended conformation similar to chemical PEG (e.g., a recombinant PEG (rPEG) molecule), such as those described in International Patent Application Publication No. WO2009/023270 and U.S. Patent Application Publication No. US20080286808. The rPEG molecule in some aspects is a polypeptide comprising one or more of glycine, serine, glutamic acid, aspartic acid, alanine, or proline. In some aspects, the rPEG is a homopolymer, e.g., poly-glycine, poly-serine, poly-glutamic acid, polyaspartic acid, poly-alanine, or poly-proline. In other embodiments, the rPEG comprises two types of amino acids repeated, e.g., poly(Gly-Ser), poly(Gly-Glu), poly(Gly-Ala), poly(Gly-Asp), poly(Gly-Pro), poly(Ser-Glu), etc. In some aspects, the rPEG comprises three different types of amino acids, e.g., poly(Gly-Ser-Glu). In specific aspects, the rPEG increases the half-life of the Glucagon and/or GLP-1 agonist analog. In some aspects, the rPEG comprises a net positive or net negative charge. The rPEG in some aspects lacks secondary structure. In some embodiments, the rPEG is greater than or equal to 10 amino acids in length and in some embodiments is about 40 to about 50 amino acids in length. The accessory peptide in some aspects is fused to the N- or C-terminus of the analog of the present disclosure through a peptide bond or a proteinase cleavage site, or is inserted into the loops of the analog of the present disclosure. The rPEG in some aspects comprises an affinity tag or is linked to a PEG that is greater than 5 kDa. In some embodiments, the rPEG confers the analog of the present disclosure with an increased hydrodynamic radius, serum half-life, protease resistance, or solubility and in some aspects confers the analog with decreased immunogenicity.

Multimers

In some embodiments in which the GIP agonist peptide is conjugated to the glucagon antagonist peptide, and the conjugate is not a fusion peptide, the conjugate is a multimer or dimer comprising the peptides of the peptide combinations. The conjugate may be a hetero-multimer or heterodimer comprising the GIP agonist peptide is conjugated to the glucagon antagonist peptide. In certain embodiments, the linker connecting the two (or more) peptides is PEG, e.g., a 5 kDa PEG, 20 kDa PEG. In some embodiments, the linker is a disulfide bond. For example, each monomer of the dimer may comprise a Cys residue (e.g., a terminal or internally positioned Cys) and the sulfur atom of each Cys residue participates in the formation of the disulfide bond. In some aspects, the monomers are connected via terminal amino acids (e.g., N-terminal or C-terminal), via internal amino acids, or via a terminal amino acid of at least one monomer and an internal amino acid of at least one other monomer. In specific aspects, the monomers are not connected via an N-terminal amino acid. In some aspects, the monomers of the multimer are attached together in a "tail-to-tail" orientation in which the C-terminal amino acids of each monomer are attached together.

Linkages

The following two sections on linkages provide description for linking a peptide to a heterologous moiety or for dimer or multimer formation. The skilled artisan will recognize that the teachings of one type of conjugate may be applicable to the other type.

Linkages—Peptide to Heterologous Moieties

The conjugation of the conjugate in some embodiments is linked to conjugate moieties via direct covalent linkage by reacting targeted amino acid residues of the analog with an organic derivatizing agent that is capable of reacting with selected side chains or the N- or C-terminal residues of these targeted amino acids. Reactive groups on the analog or conjugate moiety include, e.g., an aldehyde, amino, ester, thiol, α-haloacetyl, maleimido or hydrazino group. Derivatizing agents include, for example, maleimidobenzoyl sulfosuccinimide ester (conjugation through cysteine residues), N-hydroxysuccinimide (through lysine residues), glutaraldehyde, succinic anhydride or other agents known in the art. Alternatively, the conjugate moieties can be linked to the analog indirectly through intermediate carriers, such as polysaccharide or polypeptide carriers. Examples of polysaccharide carriers include aminodextran. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier.

Cysteinyl residues are most commonly reacted with α-haloacetates (and corresponding amines), such as chloroacetic acid, chloroacetamide to give carboxymethyl or carboxyamidomethyl derivatives. Cysteinyl residues also are derivatized by reaction with bromotrifluoroacetone, alpha-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysinyl and amino-terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate, pyridoxal phosphate, pyridoxal, chloroborohydride, trinitrobenzenesulfonic acid, O-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl side groups (aspartyl or glutamyl) are selectively modified by reaction with carbodiimides (R—N=C=N—R'), where R and R' are different alkyl groups, such as 1-cyclohexyl-3-(2-morpholinyl-4-ethyl)carbodiimide or 1-ethyl-3-(4-azonia-4,4-dimethylpentyl). Furthermore, aspartyl and glutamyl residues are converted to asparaginyl and glutaminyl residues by reaction with ammonium ions.

Other modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)), deamidation of asparagine or glutamine, acetylation of the N-terminal amine, and/or amidation or esterification of the C-terminal carboxylic acid group.

Another type of covalent modification involves chemically or enzymatically coupling glycosides to the analog. Sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of tyrosine, or tryptophan, or (f) the amide group of glutamine. These methods are described in WO87/05330 published 11 Sep. 1987, and in Aplin and Wriston, CRC Crit. Rev. Biochem., pp. 259-306 (1981).

In some embodiments, the peptide is conjugated to a heterologous moiety via covalent linkage between a side chain of an amino acid of the glucagon analog and the heterologous moiety. In some embodiments, the glucagon analog is conjugated to a heterologou moiety via the side chain of an amino acid at position 16, 17, 21, 24, or 29, a position within a C-terminal extension, or the C-terminal amino acid, or a combination of these positions. In some aspects, the amino acid covalently linked to a heterologous moiety (e.g., the amino acid comprising a heterologous moiety) is a Cys, Lys, Orn, homo-Cys, or Ac-Phe, and the side chain of the amino acid is covalently bonded to a heterologous moiety.

In some embodiments, the conjugate comprises a linker that joins the glucagon analog to the heterologous moiety. In some aspects, the linker comprises a chain of atoms from 1 to about 60, or 1 to 30 atoms or longer, 2 to 5 atoms, 2 to 10 atoms, 5 to 10 atoms, or to 20 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, the linker provides a functional group that is subject to cleavage by an enzyme or other catalyst or hydrolytic conditions found in the target tissue or organ or cell. In some embodiments, the length of the linker is long enough to reduce the potential for steric hindrance. If the linker is a covalent bond or a peptidyl bond and the conjugate is a polypeptide, the entire conjugate can be a fusion protein. Such peptidyl linkers may be any length. Exemplary linkers are from about 1 to 50 amino acids in length, 5 to 50, 3 to 5, 5 to 10, 5 to 15, or 10 to 30 amino acids in length. Such fusion proteins may alternatively be produced by recombinant genetic engineering methods known to one of ordinary skill in the art.

In some embodiments, the heterologous moiety is attached via non-covalent or covalent bonding to the analog of the present disclosure. In certain aspects, the heterologous moiety is attached to the analog of the present disclosure via a linker. Linkage can be accomplished by covalent chemical bonds, physical forces such electrostatic, hydrogen, ionic, van der Waals, or hydrophobic or hydrophilic interactions. A variety of non-covalent coupling systems may be used, including biotin-avidin, ligand/receptor, enzyme/substrate, nucleic acid/nucleic acid binding protein, lipid/lipid binding protein, cellular adhesion molecule partners; or any binding partners or fragments thereof which have affinity for each other.

Linkages—Dimers and Multimers

In some embodiments, the two peptides of the conjugate are linked together using standard linking agents and procedures known to those skilled in the art. For example, in some aspects, the two peptides of the conjugate are fused through one or more peptide bonds, with or without a spacer, e.g., a peptide or amino acid spacer. In such instances, the two peptides of the conjugate are considered as a fusion peptide. In alternative embodiments, the two peptides of the conjugate are linked together through chemical conjugation. In some embodiments, the two peptides of the conjugate are chemically conjugated together through a linking moiety. The linking moiety in some aspects are directly conjugated to each peptide, or, in alternative aspects, are indirectly conjugated to each peptide through a spacer.

In some aspects, the GIP agonist peptide and glucagon antagonist peptide of the conjugate are linked together in a "tail-to-tail" orientation in which the C-terminal amino acids of the peptides are conjugated together. In some aspects, the GIP agonist peptide and glucagon antagonist peptide of the conjugate are linked together via the side chains of internal amino acids on each peptide. In some aspects, the GIP agonist peptide and glucagon antagonist peptide of the conjugate are linked together via a C-terminal amino acid of one peptide and an internal amino acid of another peptide.

In some embodiments, two peptides of the conjugate are directly linked together and do not comprise a linking moiety. In some embodiments, the two peptides of the conjugate are linked together by conjugating both of the peptides to a single linking moiety that comprises at least two reactive groups, e.g., a bifunctional linker, a bifunctional spacer. In some embodiments, the two peptides of the conjugate are linked together by indirectly conjugating one or both of the peptides to the single linking moiety through a spacer.

In some embodiments, the C-terminal of one or more the GIP agonist peptide and glucagon antagonist peptide of the conjugate is modified to comprise a natural or normatural amino acid with a nucleophilic side chain, such as an amino acid represented by Formula I, Formula II, or Formula III, as previously described herein (see Acylation and alkylation). In exemplary embodiments, the C-terminal amino acid of one or more of the GIP agonist peptide and glucagon antagonist peptide is selected from the group consisting of lysine, ornithine, serine, cysteine, and homocysteine. In some embodiments, the C-terminal amino acid of one or more peptides of the conjugate is modified to comprise a natural or normatural amino acid with an electrophilic side chain such as, for example, Asp and Glu. In some embodiments, the C-terminal amino acids of both peptides of the conjugate comprise side chains that are nulceophilic. In some embodiments, the C-terminal amino acids of both peptides comprise side chains that are electrophilic. In some embodiments, the C-terminal amino acid of one peptide of the conjugate comprises a side chain that is nulceophilic, and the C-terminal amino acid of the other peptide of the conjugate comprises a side chain that is electrophilic.

In some embodiments, the two peptides of the conjugate are linked together by directly conjugating the C-terminal amino acids of the peptides to one another with a linking moiety. In some embodiments, the two peptides of the conjugate are linked by directly conjugating the C-terminal amino acid side chain of one peptide to the C-terminal amino acid side chain of the other peptide. In some of these embodiments, the C-terminal amino acid of one peptide comprises a nucleophilic side chain and the C-terminal amino acid of the other peptide comprises an electrophilic side chain. In some of these embodiments, both C-terminal amino acids comprise thiol side chains and linkage occurs through a disulfide bond. In some embodiments, two peptides of the conjugate are linked through a nucleophilic side chain of the C-terminal amino acid of one peptide to the alpha-carboxyl group of the C-terminal amino acid on the other peptide.

In some embodiments, the two peptides of the conjugate are linked together by conjugating the C-terminal amino acid side chains of both of the peptides to a linking moiety that comprises at least two reactive groups before conjugation to the peptides. In some embodiments, the linking moiety is a bifunctional linker and comprises only two reactive groups before conjugation to the peptides. In embodiments where the two peptides of the composition both have C-terminal amino acids with electrophilic side chains, the linking moiety comprises two of the same or two different nucleophilic groups (e.g. amine, hydroxyl, thiol) before conjugation to the peptides. In embodiments where the two peptides of the composition both have C-terminal amino acids with nucleophilic side chains, the linking moiety comprises two of the same or two different electrophilic groups (e.g. carboxyl group, activated form of a carboxyl group, compound with a leaving group) before conjugation to the peptides. In embodiments where one peptide of the composition has a C-terminal amino acid with a nucleophilic side chain and the other peptide of the composition has a C-terminal amino acid with an electrophilic side chain, the linking moiety comprises one nucleophilic group and one electrophilic group before conjugation to the peptides. In some embodiments where one or more of the two peptides of the composition are conjugated to each other through their C-terminal alpha-carboxyl groups, the linking moiety comprising two nucleophilic groups before conjugation to the peptides.

Composition of the Linking Moiety

The linking moiety can be any molecule with at least two reactive groups (before conjugation to the peptides) capable of reacting with the peptides of the composition. In some embodiments the linking moiety has only two reactive groups and is bifunctional. The linking moiety (before conjugation to the peptides) can be represented by Formula VI:

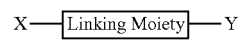

wherein X and Y are independently nucleophilic or electrophilic reactive groups. In some embodiments X and Y are either both nucleophilc groups or both electrophilic groups. In some embodiments one of X and Y is a nucleophilic group and the other of X and Y is an electrophilic group. Nonlimiting combinations of X and Y are shown below.

| Both Nucleophilic | | Both Electrophilic | | Nucleophilic/Electrophilic | |
|---|---|---|---|---|---|
| X | Y | X | Y | X | Y |
| amino | amino | carboxyl | carboxyl | amino | carboxyl |
| amino | thiol | carboxyl | acyl chloride | amino | acyl chloride |
| amino | hydroxyl | carboxyl | anhydride | amino | anhydride |
| thiol | amino | carboxyl | Ester | amino | ester |
| thiol | thiol | carboxyl | NHS | amino | NHS |
| thiol | hydroxyl | carboxyl | Halogen | amino | halogen |
| hydroxyl | amino | carboxyl | sulfonate ester | amino | sulfonate ester |
| hydroxyl | thiol | carboxyl | maleimido | amino | maleimido |
| hydroxyl | hydroxyl | carboxyl | haloacetyl | amino | haloacetyl |
| | | carboxyl | isocyanate | amino | isocyanate |
| | | acyl chloride | carboxyl | thiol | carboxyl |
| | | acyl chloride | acyl chloride | thiol | acyl chloride |
| | | acyl chloride | anhydride | thiol | anhydride |
| | | acyl chloride | Ester | thiol | ester |
| | | acyl chloride | NHS | thiol | NHS |

-continued

| Both Nucleophilic | | Both Electrophilic | | Nucleophilic/Electrophilic | |
|---|---|---|---|---|---|
| X | Y | X | Y | X | Y |
| | | acyl chloride | Halogen | thiol | halogen |
| | | acyl chloride | sulfonate ester | thiol | sulfonate ester |
| | | acyl chloride | maleimido | thiol | maleimido |
| | | acyl chloride | haloacetyl | thiol | haloacetyl |
| | | acyl chloride | isocyanate | thiol | isocyanate |
| | | anhydride | carboxyl | hydroxyl | carboxyl |
| | | anhydride | acyl chloride | hydroxyl | acyl chloride |
| | | anhydride | anhydride | hydroxyl | anhydride |
| | | anhydride | Ester | hydroxyl | ester |
| | | anhydride | NHS | hydroxyl | NHS |
| | | anhydride | Halogen | hydroxyl | halogen |
| | | anhydride | sulfonate ester | hydroxyl | sulfonate ester |
| | | anhydride | maleimido | hydroxyl | maleimido |
| | | anhydride | haloacetyl | hydroxyl | haloacetyl |
| | | anhydride | isocyanate | hydroxyl | isocyanate |
| | | ester | carboxyl | | |
| | | ester | acyl chloride | | |
| | | ester | anhydride | | |
| | | ester | Ester | | |
| | | ester | NHS | | |
| | | ester | Halogen | | |
| | | ester | sulfonate ester | | |
| | | ester | maleimido | | |
| | | ester | haloacetyl | | |
| | | ester | isocyanate | | |
| | | NHS | carboxyl | | |
| | | NHS | acyl chloride | | |
| | | NHS | anhydride | | |
| | | NHS | Ester | | |
| | | NHS | NHS | | |
| | | NHS | Halogen | | |
| | | NHS | sulfonate ester | | |
| | | NHS | maleimido | | |
| | | NHS | haloacetyl | | |
| | | NHS | isocyanate | | |
| | | halogen | carboxyl | | |
| | | halogen | acyl chloride | | |
| | | halogen | anhydride | | |
| | | halogen | Ester | | |
| | | halogen | NHS | | |
| | | halogen | Halogen | | |
| | | halogen | sulfonate ester | | |
| | | halogen | maleimido | | |
| | | halogen | haloacetyl | | |
| | | halogen | isocyanate | | |
| | | sulfonate ester | carboxyl | | |
| | | sulfonate ester | acyl chloride | | |
| | | sulfonate ester | anhydride | | |
| | | sulfonate ester | Ester | | |
| | | sulfonate ester | NHS | | |
| | | sulfonate ester | Halogen | | |
| | | sulfonate ester | sulfonate ester | | |
| | | sulfonate ester | maleimido | | |
| | | sulfonate ester | haloacetyl | | |
| | | sulfonate ester | isocyanate | | |
| | | maleimido | carboxyl | | |
| | | maleimido | acyl chloride | | |
| | | maleimido | anhydride | | |
| | | maleimido | Ester | | |
| | | maleimido | NHS | | |
| | | maleimido | Halogen | | |
| | | maleimido | sulfonate ester | | |
| | | maleimido | maleimido | | |
| | | maleimido | haloacetyl | | |
| | | maleimido | isocyanate | | |
| | | haloacetyl | carboxyl | | |
| | | haloacetyl | acyl chloride | | |
| | | haloacetyl | anhydride | | |
| | | haloacetyl | Ester | | |
| | | haloacetyl | NHS | | |
| | | haloacetyl | Halogen | | |
| | | haloacetyl | sulfonate ester | | |
| | | haloacetyl | maleimido | | |
| | | haloacetyl | haloacetyl | | |
| | | haloacetyl | isocyanate | | |

| Both Nucleophilic | | Both Electrophilic | | Nucleophilic/Electrophilic | |
|---|---|---|---|---|---|
| X | Y | X | Y | X | Y |
| | | isocyanate | carboxyl | | |
| | | isocyanate | acyl chloride | | |
| | | isocyanate | anhydride | | |
| | | isocyanate | Ester | | |
| | | isocyanate | NHS | | |
| | | isocyanate | Halogen | | |
| | | isocyanate | sulfonate ester | | |
| | | isocyanate | maleimido | | |
| | | isocyanate | haloacetyl | | |
| | | isocyanate | isocyanate | | |

Other nonlimiting examples of reactive groups include pyridyldithiol, aryl azide, diazirine, carbodiimide, and hydrazide. In some embodiments at least one reactive group of the linking moiety before conjugation to the peptides is a thiol and is conjugated to one or more of the peptides of the composition through a disulfide bond.

In some embodiments, the linking moiety is hydrophilic such as, for example, polyalkylene glycol. Before conjugation to the peptides of the composition, the hydrophilic linking moiety comprises at least two reactive groups (X and Y), as described herein and as shown below:

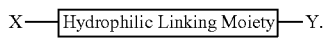

In specific embodiments, the linking moiety is polyethylene glycol (PEG). The PEG in certain embodiments has a molecular weight of about 200 Daltons to about 10,000 Daltons, e.g. about 500 Daltons to about 5000 Daltons. The PEG in some embodiments has a molecular weight of about 10,000 Daltons to about 40,000 Daltons.

In some embodiments, the hydrophilic linking moiety comprises either a maleimido or an iodoacetyl group and an activated carboxylic acid (e.g. NHS ester) as the reactive groups. An example of a hydrophilic linking moiety comprising maleimido and NHS activating groups is shown below:

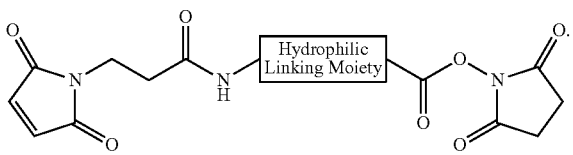

In some embodiments, the hydrophilic linking moiety comprises either a maleimido or an iodoacetyl group and a carboxylic acid as the reactive groups. In these embodiments, the maleimido or iodoacetyl group can be coupled to a thiol moiety on a peptide (e.g. side chain of cysteine) and the carboxylic acid can be coupled to a free amine on a peptide (e.g. side chain of lysine) with or without the use of a coupling reagent. Any appropriate coupling agent known to one skilled in the art can be used to couple the carboxylic acid with the free amine such as, for example, DCC, DIC, HATU, HBTU, and TBTU. For example, the hydrophilic linking moiety can comprise the following structure:

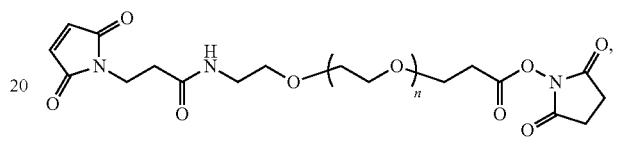

wherein n is 1 to 910.

In exemplary embodiments, the linking moiety is maleimido-PEG(20 kDa)-COOH, iodoacetyl-PEG(20 kDa)-COOH, maleimido-PEG(20 kDa)-NHS, or iodoacetyl-PEG (20 kDa)-NHS.

In some embodiments, the linking moiety is hydrophobic. Hydrophobic linkers are known in the art. See, e.g., *Bioconjugate Techniques*, G. T. Hermanson (Academic Press, San Diego, Calif., 1996), which is incorporated by reference in its entirety. Suitable hydrophobic linking moieties are known in the art and include, for example, 8-hydroxyoctanoic acid and 8-mercaptooctanoic acid. In specific embodiments, the hydrophilic linking moiety comprises an aliphatic chain of 2 to 100 methylene groups. Before conjugation to the peptides of the composition, the hydrophobic linking moiety comprises at least two reactive groups (X and Y), as described herein and as shown below:

In some specific embodiments, the hydrophobic linking moiety comprises either a maleimido or an iodoacetyl group and an activated carboxylic acid (e.g. NHS ester) as the reactive groups. An example of a hydrophobic linker comprising maleimido and NHS ester reactive groups is shown below:

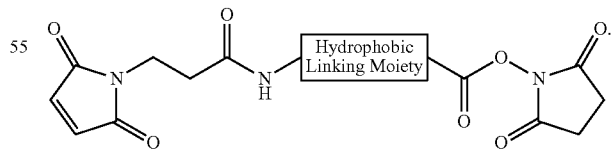

In some specific embodiments, the hydrophobic linking moiety comprises either a maleimido or an iodoacetyl group and a carboxylic acid. In these embodiments, the maleimido or iodoacetyl group can be coupled to a thiol moiety on a peptide (e.g. side chain of cysteine) and the carboxylic acid can be coupled to a free amine on a peptide (e.g. side chain of lysine) with or without the use of a coupling reagent. Any coupling agent known to one skilled in the art can be used to couple the carboxylic acid with the free amine such as, for example, DCC, DIC, HATU, HBTU, and TBTU. For example, the hydrophobic linking moiety can comprise the following structure:

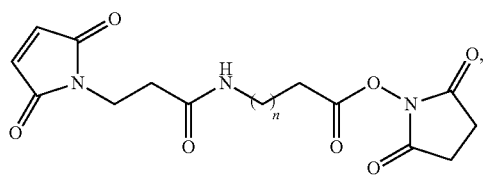

wherein n is 1 to 500.

In some embodiments, the linking moiety is comprised of an amino acid, a dipeptide, a tripeptide, or a polypeptide, wherein the amino acid, dipeptide, tripeptide, or polypeptide comprises at least two activating groups, as described herein.

Spacer

In some embodiments, the linking moiety is indirectly attached to one or more peptides of the composition (e.g. the first peptide and/or second peptide) through a spacer. Before conjugation, the spacer is bifunctional and comprises two reactive groups. In some embodiments, both reactive groups of the spacer are the same or different nucleophilic groups (e.g. amine, hydroxyl, thiol). In some embodiments, both reactive groups of the spacer are the same or different electrophilic groups (e.g. carboxyl group, activated form of a carboxyl group, compound with a leaving group). In some embodiments, one reactive group of the spacer is nucleophilic and the other reactive group of the spacer is electrophilic. Nonlimiting combinations of the reactive groups on the spacer before conjugation are shown below.

| Both Nucleophilic | | Both Electrophilic | | Nucleophilic/Electrophilic | |
| --- | --- | --- | --- | --- | --- |
| X | Y | X | Y | X | Y |
| amino | amino | carboxyl | carboxyl | amino | carboxyl |
| amino | thiol | carboxyl | acyl chloride | amino | acyl chloride |
| amino | hydroxyl | carboxyl | anhydride | amino | anhydride |
| thiol | amino | carboxyl | Ester | amino | ester |
| thiol | thiol | carboxyl | NHS | amino | NHS |
| thiol | hydroxyl | carboxyl | Halogen | amino | halogen |
| hydroxyl | amino | carboxyl | sulfonate ester | amino | sulfonate ester |
| hydroxyl | thiol | carboxyl | maleimido | amino | maleimido |
| hydroxyl | hydroxyl | carboxyl | haloacetyl | amino | haloacetyl |
| | | carboxyl | isocyanate | amino | isocyanate |
| | | acyl chloride | carboxyl | thiol | carboxyl |
| | | acyl chloride | acyl chloride | thiol | acyl chloride |
| | | acyl chloride | anhydride | thiol | anhydride |
| | | acyl chloride | Ester | thiol | ester |
| | | acyl chloride | NHS | thiol | NHS |
| | | acyl chloride | Halogen | thiol | halogen |
| | | acyl chloride | sulfonate ester | thiol | sulfonate ester |
| | | acyl chloride | maleimido | thiol | maleimido |
| | | acyl chloride | haloacetyl | thiol | haloacetyl |
| | | acyl chloride | isocyanate | thiol | isocyanate |
| | | anhydride | carboxyl | hydroxyl | carboxyl |
| | | anhydride | acyl chloride | hydroxyl | acyl chloride |
| | | anhydride | anhydride | hydroxyl | anhydride |
| | | anhydride | Ester | hydroxyl | ester |
| | | anhydride | NHS | hydroxyl | NHS |
| | | anhydride | Halogen | hydroxyl | halogen |
| | | anhydride | sulfonate ester | hydroxyl | sulfonate ester |
| | | anhydride | maleimido | hydroxyl | maleimido |
| | | anhydride | haloacetyl | hydroxyl | haloacetyl |
| | | anhydride | isocyanate | hydroxyl | isocyanate |
| | | ester | carboxyl | | |
| | | ester | acyl chloride | | |
| | | ester | anhydride | | |
| | | ester | Ester | | |
| | | ester | NHS | | |
| | | ester | Halogen | | |
| | | ester | sulfonate ester | | |
| | | ester | maleimido | | |
| | | ester | haloacetyl | | |
| | | ester | isocyanate | | |
| | | NHS | carboxyl | | |
| | | NHS | acyl chloride | | |
| | | NHS | anhydride | | |
| | | NHS | Ester | | |
| | | NHS | NHS | | |
| | | NHS | Halogen | | |
| | | NHS | sulfonate ester | | |
| | | NHS | maleimido | | |
| | | NHS | haloacetyl | | |
| | | NHS | isocyanate | | |
| | | halogen | carboxyl | | |
| | | halogen | acyl chloride | | |
| | | halogen | anhydride | | |
| | | halogen | Ester | | |

-continued

| Both Nucleophilic | | Both Electrophilic | | Nucleophilic/Electrophilic | |
|---|---|---|---|---|---|
| X | Y | X | Y | X | Y |
| | | halogen | NHS | | |
| | | halogen | Halogen | | |
| | | halogen | sulfonate ester | | |
| | | halogen | maleimido | | |
| | | halogen | haloacetyl | | |
| | | halogen | isocyanate | | |
| | | sulfonate ester | carboxyl | | |
| | | sulfonate ester | acyl chloride | | |
| | | sulfonate ester | anhydride | | |
| | | sulfonate ester | Ester | | |
| | | sulfonate ester | NHS | | |
| | | sulfonate ester | Halogen | | |
| | | sulfonate ester | sulfonate ester | | |
| | | sulfonate ester | maleimido | | |
| | | sulfonate ester | haloacetyl | | |
| | | sulfonate ester | isocyanate | | |
| | | maleimido | carboxyl | | |
| | | maleimido | acyl chloride | | |
| | | maleimido | anhydride | | |
| | | maleimido | Ester | | |
| | | maleimido | NHS | | |
| | | maleimido | Halogen | | |
| | | maleimido | sulfonate ester | | |
| | | maleimido | maleimido | | |
| | | maleimido | haloacetyl | | |
| | | maleimido | isocyanate | | |
| | | haloacetyl | carboxyl | | |
| | | haloacetyl | acyl chloride | | |
| | | haloacetyl | anhydride | | |
| | | haloacetyl | Ester | | |
| | | haloacetyl | NHS | | |
| | | haloacetyl | Halogen | | |
| | | haloacetyl | sulfonate ester | | |
| | | haloacetyl | maleimido | | |
| | | haloacetyl | haloacetyl | | |
| | | haloacetyl | isocyanate | | |
| | | isocyanate | carboxyl | | |
| | | isocyanate | acyl chloride | | |
| | | isocyanate | anhydride | | |
| | | isocyanate | Ester | | |
| | | isocyanate | NHS | | |
| | | isocyanate | halogen | | |
| | | isocyanate | sulfonate ester | | |
| | | isocyanate | maleimido | | |
| | | isocyanate | haloacetyl | | |
| | | isocyanate | isocyanate | | |

Other nonlimiting examples of reactive groups include pyridyldithiol, aryl azide, diazirine, carbodiimide, and hydrazide.

In some embodiments, the bifunctional spacer is hydrophilic. In certain embodiments, the reactive groups on the hydrophilic bifunctional spacer are a hydroxyl and a carboxylate. In other embodiments, the reactive groups on the hydrophilic bifunctional spacer are an amine and a carboxylate. In other embodiments, the reactive groups on the hydrophilic bifunctional spacer are a thiol and a carboxylate. In specific embodiments, the spacer comprises an amino poly(alkyloxy)carboxylate. In this regard, the spacer can comprise, for example, $NH_2(CH_2CH_2O)_n(CH_2)_mCOOH$, wherein m is any integer from 1 to 6 and n is any integer from 2 to 12, such as, e.g., 8-amino-3,6-dioxaoctanoic acid, which is commercially available from Peptides International, Inc. (Louisville, Ky.).

In some embodiments, the spacer is hydrophobic. Hydrophobic bifunctional spacers are known in the art. See, e.g., *Bioconjugate Techniques*, G. T. Hermanson (Academic Press, San Diego, Calif., 1996), which is incorporated by reference in its entirety. In certain embodiments, the reactive groups on the hydrophobic bifunctional spacer are a hydroxyl and a carboxylate. In other embodiments, the reactive groups on the hydrophobic bifunctional spacer are an amine and a carboxylate. In other embodiments, the reactive groups on the hydrophobic bifunctional spacer are a thiol and a carboxylate. Suitable hydrophobic bifunctional spacers comprising a carboxylate, and a hydroxyl group or a thiol group are known in the art and include, for example, 8-hydroxyoctanoic acid and 8-mercaptooctanoic acid.

In some embodiments, the spacer is an amino acid comprising a side chain amine, hydroxyl, or thiol, or a dipeptide or tripeptide comprising an amino acid comprising a side chain amine, hydroxyl, or thiol, as previously described herein (see Acylation and alkylation). The spacer (e.g., amino acid, dipeptide, tripeptide, hydrophilic bifunctional, or hydrophobic bifunctional spacer) in specific embodiments is 3 to 10 atoms (e.g., 6 to 10 atoms, (e.g., 6, 7, 8, 9, or 10 atoms) in length. In more specific embodiments, the spacer is about 3 to 10 atoms (e.g., 6 to 10 atoms) in length In some aspects, one or more peptides of the conjugate (e.g. the first peptide and/or the second peptide) is linked to another peptide of the composition via the side chain of an internal amino acid. In some embodiments, the internal amino acid comprises a nucleophilic side chain, such as an amino acid represented by Formula I, Formula II, or Formula III, as previously described herein (see Acylation and alkylation). In some embodiments, the internal amino acid is selected from the group consisting of lysine, ornithine, serine, cysteine, and homocysteine. In exemplary embodiments, the internal amino acid is cysteine. In some embodiments, the internal amino acid comprises an electrophilic side chain such as, for example, Asp and Glu.

In some embodiments, the internal amino acid of one peptide of the composition (e.g. the first peptide) is linked to the C-terminal amino acid of the other peptide of the composition (e.g. the second peptide). In some embodiments, the internal amino acid of one peptide of the composition (e.g. the first peptide) is linked to an internal amino acid of the other peptide of the composition (e.g. the second peptide).

In some embodiments, the internal amino acid of one peptide of the composition is directly linked (e.g. no linking moiety) to either an internal amino acid or the C-terminal amino acid of another peptide of the composition. In some embodiments, the internal amino acid of one peptide of the composition is linked to either an internal amino acid or the C-terminal amino acid of another peptide of the composition through a linking moiety, as described herein. In some embodiments, the internal amino acid of one peptide of the composition is directly linked to the linking moiety, as described herein. In some embodiments, the internal amino acid of one peptide of the composition is indirectly linked to the linking moiety through a spacer, as described herein.

In some embodiments, the first and second peptide of the composition are linked together to form a heterodimer. In some embodiments two analogs of the first peptide and or two analogs of the second peptide are linked together to form a homodimer. In some exemplary embodiments, the side chain of a cysteine residue at the C-terminus of the first peptide is linked to the side chain of a lysine residue at the C-terminus of the second peptide via a hydrophilic linker comprised of polyethylene glycol. In some exemplary embodiments, the side chain of a cysteine residue at position 24 of the first peptide is linked to the side chain of a lysine residue at the C-terminus of the second peptide via a hydrophilic linker comprised of polyethylene glycol, as shown below:

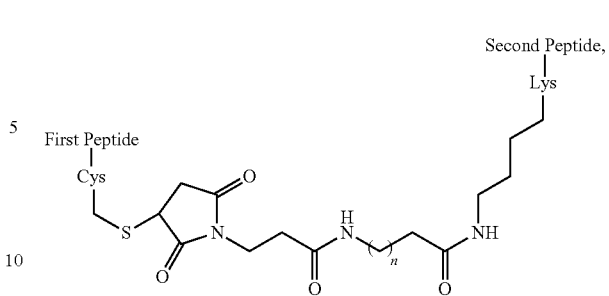

wherein n is 1 to 500.

Compositions, Pharmaceutical Compositions

The present disclosures provide compositions comprising any of the GIP agonist peptides described herein and any of the glucagon antagonist peptides described herein. In some embodiments, the composition comprises a GIP agonist peptide which exhibits at least 0.1% activity of native GIP at the GIP receptor and glucagon antagonist peptide which exhibits at least 60% inhibition of the maximum response achieved by glucagon at the glucagon receptor. In some embodiments, the composition is intended for therapeutic use in mammals, e.g., humans.

Pharmaceutical Salts

In some embodiments, the peptide(s) of the present disclosures (the GIP against peptide, the glucagon antagonist peptide, or both) is present in the composition (or conjugate) in the form of a salt, e.g., a pharmaceutically acceptable; salt. As used herein the term "pharmaceutically acceptable salt" refers to salts of compounds that retain the biological activity of the parent compound, and which are not biologically or otherwise undesirable. Such salts can be prepared in situ during the final isolation and purification of the analog, or separately prepared by reacting a free base function with a suitable acid. Many of the compounds disclosed herein are capable of forming acid and/or base salts by virtue of the presence of amino and/or carboxyl groups or groups similar thereto.

Pharmaceutically acceptable acid addition salts may be prepared from inorganic and organic acids. Representative acid addition salts include, but are not limited to acetate, adipate, alginate, citrate, aspartate, benzoate, benzenesulfonate, bisulfate, butyrate, camphorate, camphor sulfonate, digluconate, glycerophosphate, hemisulfate, heptanoate,

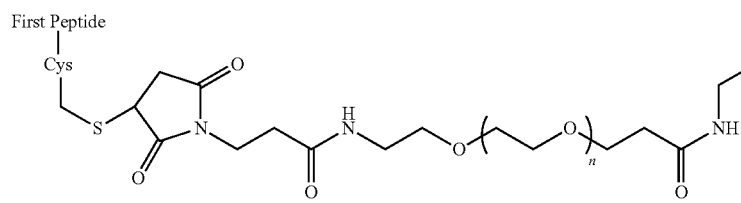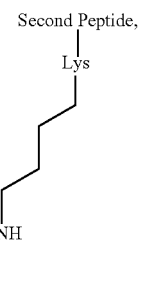

wherein n is 1 to 910.

In some exemplary embodiments, the side chain of a cysteine residue at position 24 of the first peptide is linked to the side chain of a lysine residue at the C-terminus of the second peptide via a hydrophobic linker comprised of an aliphatic chain, as shown below:

hexanoate, fumarate, hydrochloride, hydrobromide, hydroiodide, 2-hydroxyethansulfonate (isothionate), lactate, maleate, methane sulfonate, nicotinate, 2-naphthalene sulfonate, oxalate, palmitoate, pectinate, persulfate, 3-phenyl-propionate, picrate, pivalate, propionate, succinate, tartrate, thiocyanate, phosphate, glutamate, bicarbonate, p-toluenesulfonate, and undecanoate. Salts derived from inorganic acids include hydrochloric acid, hydrobromic acid, sulfuric acid, nitric acid, phosphoric acid, and the like. Salts derived from organic acids include acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluene-sulfonic acid, salicylic acid, and the like. Examples of acids which can be employed to form pharmaceutically acceptable acid addition salts include, for example, an inorganic acid, e.g., hydrochloric acid, hydrobromic acid, sulphuric acid, and phosphoric acid, and an organic acid, e.g., oxalic acid, maleic acid, succinic acid, and citric acid.

Basic addition salts also can be prepared in situ during the final isolation and purification of the source of salicylic acid, or by reacting a carboxylic acid-containing moiety with a suitable base such as the hydroxide, carbonate, or bicarbonate of a pharmaceutically acceptable metal cation or with ammonia or an organic primary, secondary, or tertiary amine. Pharmaceutically acceptable salts include, but are not limited to, cations based on alkali metals or alkaline earth metals such as lithium, sodium, potassium, calcium, magnesium, and aluminum salts, and the like, and nontoxic quaternary ammonia and amine cations including ammonium, tetramethylammonium, tetraethylammonium, methylammonium, dimethylammonium, trimethylammonium, triethylammonium, diethylammonium, and ethylammonium, amongst others. Other representative organic amines useful for the formation of base addition salts include, for example, ethylenediamine, ethanolamine, diethanolamine, piperidine, piperazine, and the like. Salts derived from organic bases include, but are not limited to, salts of primary, secondary and tertiary amines.

Further, basic nitrogen-containing groups can be quaternized with the peptide of the present disclosure (the GIP agonist peptide, the glucagon antagonist peptide, or both) as lower alkyl halides such as methyl, ethyl, propyl, and butyl chlorides, bromides, and iodides; long chain halides such as decyl, lauryl, myristyl, and stearyl chlorides, bromides, and iodides; arylalkyl halides like benzyl and phenethyl bromides and others. Water or oil-soluble or dispersible products are thereby obtained.

Formulations

In accordance with some embodiments, the composition of the present disclosures is a pharmaceutical composition and further comprises a pharmaceutically acceptable carrier. The pharmaceutical composition can comprise any pharmaceutically acceptable ingredient, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface active agents, surfactants, suspending agents, sweetening agents, therapeutic agents, thickening agents, tonicity agents, toxicity agents, viscosity-increasing agents, water-absorbing agents, water-miscible cosolvents, water softeners, or wetting agents.

In some embodiments, the pharmaceutical composition comprises any one or a combination of the following components: acacia, acesulfame potassium, acetyltributyl citrate, acetyltriethyl citrate, agar, albumin, alcohol, dehydrated alcohol, denatured alcohol, dilute alcohol, aleuritic acid, alginic acid, aliphatic polyesters, alumina, aluminum hydroxide, aluminum stearate, amylopectin, $\alpha$-amylose, ascorbic acid, ascorbyl palmitate, aspartame, bacteriostatic water for injection, bentonite, bentonite magma, benzalkonium chloride, benzethonium chloride, benzoic acid, benzyl alcohol, benzyl benzoate, bronopol, butylated hydroxyanisole, butylated hydroxytoluene, butylparaben, butylparaben sodium, calcium alginate, calcium ascorbate, calcium carbonate, calcium cyclamate, dibasic anhydrous calcium phosphate, dibasic dehydrate calcium phosphate, tribasic calcium phosphate, calcium propionate, calcium silicate, calcium sorbate, calcium stearate, calcium sulfate, calcium sulfate hemihydrate, canola oil, carbomer, carbon dioxide, carboxymethyl cellulose calcium, carboxymethyl cellulose sodium, $\beta$-carotene, carrageenan, castor oil, hydrogenated castor oil, cationic emulsifying wax, cellulose acetate, cellulose acetate phthalate, ethyl cellulose, microcrystalline cellulose, powdered cellulose, silicified microcrystalline cellulose, sodium carboxymethyl cellulose, cetostearyl alcohol, cetrimide, cetyl alcohol, chlorhexidine, chlorobutanol, chlorocresol, cholesterol, chlorhexidine acetate, chlorhexidine gluconate, chlorhexidine hydrochloride, chlorodifluoroethane (HCFC), chlorodifluoromethane, chlorofluorocarbons (CFC)chlorophenoxyethanol, chloroxylenol, corn syrup solids, anhydrous citric acid, citric acid monohydrate, cocoa butter, coloring agents, corn oil, cottonseed oil, cresol, m-cresol, o-cresol, p-cresol, croscarmellose sodium, crospovidone, cyclamic acid, cyclodextrins, dextrates, dextrin, dextrose, dextrose anhydrous, diazolidinyl urea, dibutyl phthalate, dibutyl sebacate, diethanolamine, diethyl phthalate, difluoroethane (HFC), dimethyl-$\beta$-cyclodextrin, cyclodextrin-type compounds such as Captisol®, dimethyl ether, dimethyl phthalate, dipotassium edentate, disodium edentate, disodium hydrogen phosphate, docusate calcium, docusate potassium, docusate sodium, dodecyl gallate, dodecyltrimethylammonium bromide, edentate calcium disodium, edtic acid, eglumine, ethyl alcohol, ethylcellulose, ethyl gallate, ethyl laurate, ethyl maltol, ethyl oleate, ethylparaben, ethylparaben potassium, ethylparaben sodium, ethyl vanillin, fructose, fructose liquid, fructose milled, fructose pyrogen-free, powdered fructose, fumaric acid, gelatin, glucose, liquid glucose, glyceride mixtures of saturated vegetable fatty acids, glycerin, glyceryl behenate, glyceryl monooleate, glyceryl monostearate, self-emulsifying glyceryl monostearate, glyceryl palmitostearate, glycine, glycols, glycofurol, guar gum, heptafluoropropane (HFC), hexadecyltrimethylammonium bromide, high fructose syrup, human serum albumin, hydrocarbons (HC), dilute hydrochloric acid, hydrogenated vegetable oil, type II, hydroxyethyl cellulose, 2-hydroxyethyl-$\beta$-cyclodextrin, hydroxypropyl cellulose, low-substituted hydroxypropyl cellulose, 2-hydroxypropyl-$\beta$-cyclodextrin, hydroxypropyl methylcellulose, hydroxypropyl methylcellulose phthalate, imidurea, indigo carmine, ion exchangers, iron oxides, isopropyl alcohol, isopropyl myristate, isopropyl palmitate, isotonic saline, kaolin, lactic acid, lactitol, lactose, lanolin, lanolin alcohols, anhydrous lanolin, lecithin, magnesium aluminum silicate, magnesium carbonate, normal magnesium carbonate, magnesium carbonate anhydrous, magnesium carbonate hydroxide, magnesium hydroxide, magnesium lauryl sulfate, magnesium oxide, magnesium silicate, magnesium stearate, magnesium trisilicate, magnesium trisilicate anhydrous, malic acid, malt, maltitol, maltitol solution, maltodextrin, maltol, maltose, mannitol, medium chain triglycerides, meglumine, menthol, methylcellulose, methyl methacrylate, methyl oleate, methylparaben, methylparaben potassium, methylparaben sodium, microcrystalline cellulose and carboxymethylcellulose sodium, mineral oil, light mineral oil, mineral oil and lanolin alcohols, oil, olive oil, monoethanolamine, montmorillonite, octyl gallate, oleic acid, palmitic acid, paraffin, peanut oil, petrolatum, petrolatum and lanolin alcohols, pharmaceutical glaze, phenol, liquified phenol, phenoxyethanol, phenoxypropanol, phenylethyl alcohol, phenylmercuric acetate, phenylmercuric borate, phenylmercuric nitrate, polacrilin, polacrilin potassium, poloxamer, polydextrose, polyethylene glycol, polyethylene oxide, polyacrylates, polyethylene-polyoxypropylene-block polymers, polymethacrylates, polyoxyethylene alkyl ethers, polyoxyethylene castor oil derivatives, polyoxyethylene sorbitol fatty acid esters, polyoxyethylene stearates, polyvinyl alcohol, polyvinyl pyrrolidone, potassium alginate, potassium benzoate, potassium bicarbonate, potassium bisulfite, potassium chloride, potassium citrate, potassium citrate anhydrous, potassium hydrogen phosphate, potassium metabisulfite, monobasic potassium phosphate, potassium propionate, potassium sorbate, povidone, propanol, propionic acid, propylene carbonate, propylene glycol, propylene glycol alginate, propyl gallate, propylparaben, propylparaben potassium, propylparaben sodium, protamine sulfate, rapeseed oil, Ringer's solution, saccharin, saccharin ammonium, saccharin calcium, saccharin sodium, safflower oil, saponite, serum proteins, sesame oil, colloidal silica, colloidal silicon dioxide, sodium alginate, sodium ascorbate, sodium benzoate, sodium bicarbonate, sodium bisulfite, sodium chloride, anhydrous sodium citrate, sodium citrate dehydrate, sodium chloride, sodium cyclamate, sodium edentate, sodium dodecyl sulfate, sodium lauryl sulfate, sodium metabisulfite, sodium phosphate, dibasic, sodium phosphate, monobasic, sodium phosphate, tribasic, anhydrous sodium propionate, sodium propionate, sodium sorbate, sodium starch glycolate, sodium stearyl fumarate, sodium sulfite, sorbic acid, sorbitan esters (sorbitan fatty esters), sorbitol, sorbitol solution 70%, soybean oil, spermaceti wax, starch, corn starch, potato starch, pregelatinized starch, sterilizable maize starch, stearic acid, purified stearic acid, stearyl alcohol, sucrose, sugars, compressible sugar, confectioner's sugar, sugar spheres, invert sugar, Sugartab, Sunset Yellow FCF, synthetic paraffin, talc, tartaric acid, tartrazine, tetrafluoroethane (HFC), theobroma oil, thimerosal, titanium dioxide, alpha tocopherol, tocopheryl acetate, alpha tocopheryl acid succinate, beta-tocopherol, delta-tocopherol, gamma-tocopherol, tragacanth, triacetin, tributyl citrate, triethanolamine, triethyl citrate, trimethyl-β-cyclodextrin, trimethyltetradecylammonium bromide, tris buffer, trisodium edentate, vanillin, type I hydrogenated vegetable oil, water, soft water, hard water, carbon dioxide-free water, pyrogen-free water, water for injection, sterile water for inhalation, sterile water for injection, sterile water for irrigation, waxes, anionic emulsifying wax, carnauba wax, cationic emulsifying wax, cetyl ester wax, microcrystalline wax, nonionic emulsifying wax, suppository wax, white wax, yellow wax, white petrolatum, wool fat, xanthan gum, xylitol, zein, zinc propionate, zinc salts, zinc stearate, or any excipient in the *Handbook of Pharmaceutical Excipients*, Third Edition, A. H. Kibbe (Pharmaceutical Press, London, UK, 2000), which is incorporated by reference in its entirety. *Remington's Pharmaceutical Sciences*, Sixteenth Edition, E. W. Martin (Mack Publishing Co., Easton, Pa., 1980), which is incorporated by reference in its entirety, discloses various components used in formulating pharmaceutically acceptable compositions and known techniques for the preparation thereof. Except insofar as any conventional agent is incompatible with the pharmaceutical compositions, its use in pharmaceutical compositions is contemplated. Supplementary active ingredients also can be incorporated into the compositions.

In some embodiments, the foregoing component(s) may be present in the pharmaceutical composition at any concentration, such as, for example, at least A, wherein A is 0.0001% w/v, 0.001% w/v, 0.01% w/v, 0.1% w/v, 1% w/v, 2% w/v, 5% w/v, 10% w/v, 20% w/v, 30% w/v, 40% w/v, 50% w/v, 60% w/v, 70% w/v, 80% w/v, or 90% w/v. In some embodiments, the foregoing component(s) may be present in the pharmaceutical composition at any concentration, such as, for example, at most B, wherein B is 90% w/v, 80% w/v, 70% w/v, 60% w/v, 50% w/v, 40% w/v, 30% w/v, 20% w/v, 10% w/v, 5% w/v, 2% w/v, 1% w/v, 0.1% w/v, 0.001% w/v, or 0.0001%. In other embodiments, the foregoing component(s) may be present in the pharmaceutical composition at any concentration range, such as, for example from about A to about B. In some embodiments, A is 0.0001% and B is 90%.

The pharmaceutical compositions may be formulated to achieve a physiologically compatible pH. In some embodiments, the pH of the pharmaceutical composition may be at least 5, at least 5.5, at least 6, at least 6.5, at least 7, at least 7.5, at least 8, at least 8.5, at least 9, at least 9.5, at least 10, or at least 10.5 up to and including pH 11, depending on the formulation and route of administration. In certain embodiments, the pharmaceutical compositions may comprise buffering agents to achieve a physiological compatible pH. The buffering agents may include any compounds capabale of buffering at the desired pH such as, for example, phosphate buffers (e.g., PBS), triethanolamine, Tris, bicine, TAPS, tricine, HEPES, TES, MOPS, PIPES, cacodylate, MES, and others. In certain embodiments, the strength of the buffer is at least 0.5 mM, at least 1 mM, at least 5 mM, at least 10 mM, at least 20 mM, at least 30 mM, at least 40 mM, at least 50 mM, at least 60 mM, at least 70 mM, at least 80 mM, at least 90 mM, at least 100 mM, at least 120 mM, at least 150 mM, or at least 200 mM. In some embodiments, the strength of the buffer is no more than 300 mM (e.g., at most 200 mM, at most 100 mM, at most 90 mM, at most 80 mM, at most 70 mM, at most 60 mM, at most 50 mM, at most 40 mM, at most 30 mM, at most 20 mM, at most 10 mM, at most 5 mM, at most 1 mM).

Routes of Administration

The following discussion on routes of administration is merely provided to illustrate exemplary embodiments and should not be construed as limiting the scope in any way.

Formulations suitable for oral administration can consist of (a) liquid solutions, such as an effective amount of the peptide of the present disclosures (the GIP agonist peptide, the glucagon antagonist peptide, or both) dissolved in diluents, such as water, saline, or orange juice; (b) capsules, sachets, tablets, lozenges, and troches, each containing a predetermined amount of the active ingredient, as solids or granules; (c) powders; (d) suspensions in an appropriate liquid; and (e) suitable emulsions. Liquid formulations may include diluents, such as water and alcohols, for example, ethanol, benzyl alcohol, and the polyethylene alcohols, either with or without the addition of a pharmaceutically acceptable surfactant. Capsule forms can be of the ordinary hard- or soft-shelled gelatin type containing, for example, surfactants, lubricants, and inert fillers, such as lactose, sucrose, calcium phosphate, and corn starch. Tablet forms can include one or more of lactose, sucrose, mannitol, corn starch, potato starch, alginic acid, microcrystalline cellulose, acacia, gelatin, guar gum, colloidal silicon dioxide, croscarmellose sodium, talc, magnesium stearate, calcium stearate, zinc stearate, stearic acid, and other excipients, colorants, diluents, buffering agents, disintegrating agents, moistening agents, preservatives, flavoring agents, and other pharmacologically compatible excipients. Lozenge forms can comprise the peptide of the present disclosures (the GIP agonist peptide, the glucagon antagonist peptide, or both) in a flavor, usually sucrose and acacia or tragacanth, as well as pastilles comprising the peptide of the present disclosure (the GIP agonist peptide, the glucagon antagonist peptide, or both) in an inert base, such as gelatin and glycerin, or sucrose and acacia, emulsions, gels, and the like containing, in addition to, such excipients as are known in the art.

The peptides of the disclosures (the GIP agonist peptide, the glucagon antagonist peptide, or both), alone or in combination with other suitable components, can be delivered via pulmonary administration and can be made into aerosol formulations to be administered via inhalation. These aerosol formulations can be placed into pressurized acceptable propellants, such as dichlorodifluoromethane, propane, nitrogen, and the like. They also may be formulated as pharmaceuticals for non-pressured preparations, such as in a nebulizer or an atomizer. Such spray formulations also may be used to spray mucosa. In some embodiments, the peptide (the GIP agonist peptide, the glucagon antagonist peptide, or both) is formulated into a powder blend or into microparticles or nanoparticles. Suitable pulmonary formulations are known in the art. See, e.g., Qian et al., Int J Pharm 366: 218-220 (2009); Adjei and Garren, Pharmaceutical Research, 7(6): 565-569 (1990); Kawashima et al., J Controlled Release 62(1-2): 279-287 (1999); Liu et al., Pharm Res 10(2): 228-232 (1993); International Patent Application Publication Nos. WO 2007/133747 and WO 2007/141411.

Formulations suitable for parenteral administration include aqueous and non-aqueous, isotonic sterile injection solutions, which can contain anti-oxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The term, "parenteral" means not through the alimentary canal but by some other route such as subcutaneous, intramuscular, intraspinal, or intravenous. The peptide of the present disclosure (the GIP agonist peptide, the glucagon antagonist peptide, or both) can be administered with a physiologically acceptable diluent in a pharmaceutical carrier, such as a sterile liquid or mixture of liquids, including water, saline, aqueous dextrose and related sugar solutions, an alcohol, such as ethanol or hexadecyl alcohol, a glycol, such as propylene glycol or polyethylene glycol, dimethylsulfoxide, glycerol, ketals such as 2,2-dimethyl-153-dioxolane-4-methanol, ethers, poly(ethyleneglycol) 400, oils, fatty acids, fatty acid esters or glycerides, or acetylated fatty acid glycerides with or without the addition of a pharmaceutically acceptable surfactant, such as a soap or a detergent, suspending agent, such as pectin, carbomers, methylcellulose, hydroxypropylmethylcellulose, or carboxymethylcellulose, or emulsifying agents and other pharmaceutical adjuvants.

Oils, which can be used in parenteral formulations include petroleum, animal, vegetable, or synthetic oils. Specific examples of oils include peanut, soybean, sesame, cottonseed, corn, olive, petrolatum, and mineral. Suitable fatty acids for use in parenteral formulations include oleic acid, stearic acid, and isostearic acid. Ethyl oleate and isopropyl myristate are examples of suitable fatty acid esters.

Suitable soaps for use in parenteral formulations include fatty alkali metal, ammonium, and triethanolamine salts, and suitable detergents include (a) cationic detergents such as, for example, dimethyl dialkyl ammonium halides, and alkyl pyridinium halides, (b) anionic detergents such as, for example, alkyl, aryl, and olefin sulfonates, alkyl, olefin, ether, and monoglyceride sulfates, and sulfosuccinates, (c) nonionic detergents such as, for example, fatty amine oxides, fatty acid alkanolamides, and polyoxyethylenepolypropylene copolymers, (d) amphoteric detergents such as, for example, alkyl-β-aminopropionates, and 2-alkyl-imidazoline quaternary ammonium salts, and (e) mixtures thereof.

The parenteral formulations will typically contain from about 0.5% to about 25% by weight of the peptide of the present disclosure (the GIP agonist peptide, the glucagon antagonist peptide, or both) in solution. Preservatives and buffers may be used. In order to minimize or eliminate irritation at the site of injection, such compositions may contain one or more nonionic surfactants having a hydrophile-lipophile balance (HLB) of from about 12 to about 17. The quantity of surfactant in such formulations will typically range from about 5% to about 15% by weight. Suitable surfactants include polyethylene glycol sorbitan fatty acid esters, such as sorbitan monooleate and the high molecular weight adducts of ethylene oxide with a hydrophobic base, formed by the condensation of propylene oxide with propylene glycol. The parenteral formulations can be presented in unit-dose or multi-dose sealed containers, such as ampoules and vials, and can be stored in a freeze-dried (lyophilized) condition requiring only the addition of the sterile liquid excipient, for example, water, for injections, immediately prior to use. Extemporaneous injection solutions and suspensions can be prepared from sterile powders, granules, and tablets of the kind previously described.

Injectable formulations are in accordance with the invention. The requirements for effective pharmaceutical carriers for injectable compositions are well-known to those of ordinary skill in the art (see, e.g., *Pharmaceutics and Pharmacy Practice*, J. B. Lippincott Company, Philadelphia, Pa., Banker and Chalmers, eds., pages 238-250 (1982), and *ASHP Handbook on Injectable Drugs*, Toissel, 4th ed., pages 622-630 (1986)).

Additionally, the peptide of the present disclosures (the GIP agonist peptide, the glucagon antagonist peptide, or both) can be made into suppositories for rectal administration by mixing with a variety of bases, such as emulsifying bases or water-soluble bases. Formulations suitable for vaginal administration can be presented as pessaries, tampons, creams, gels, pastes, foams, or spray formulas containing, in addition to the active ingredient, such carriers as are known in the art to be appropriate.

It will be appreciated by one of skill in the art that, in addition to the above-described pharmaceutical compositions, the peptide of the disclosures (the GIP agonist peptide, the glucagon antagonist peptide, or both) can be formulated as inclusion complexes, such as cyclodextrin inclusion complexes, or liposomes.

Dose

The compositions of the present disclosures comprising a GIP agonist peptide and a glucagon antagonist peptide, as described herein are believed to be useful in methods of treating a disease or medical condition in which glucagon receptor antagonism and GIP receptor agonism (and, optionally, GLP-1 receptor agonism) play a role. For purposes of the present disclosures, the amount or dose of the composition of the present disclosure administered should be sufficient to effect, e.g., a therapeutic or prophylactic response, in the subject or animal over a reasonable time frame. For example, the dose of the composition of the present disclosures should be sufficient to stimulate cAMP secretion from cells as described herein or sufficient to decrease blood glucose levels, fat levels, food intake levels, or body weight of a mammal, in a period of from about 1 to 4 minutes, 1 to 4 hours or 1 to 4 weeks or longer, e.g., 5 to 20 or more weeks, from the time of administration. In certain embodiments, the time period could be even longer. The dose will be determined by the efficacy of the particular composition of the present disclosure and the condition of the animal (e.g., human), as well as the body weight of the animal (e.g., human) to be treated.

Many assays for determining an administered dose are known in the art. For purposes herein, an assay, which comprises comparing the extent to which blood glucose levels or body weight are lowered upon administration of a given dose of the composition of the present disclosures to a mammal among a set of mammals of which is each given a different dose of the composition, could be used to determine a starting dose to be administered to a mammal. The extent to which blood glucose levels or body weight are lowered upon administration of a certain dose can be assayed by methods known in the art, including, for instance, the methods described herein as Examples 7-11.

Typically, the attending physician will decide the dosage of the composition of the present disclosure with which to treat each individual patient, taking into consideration a variety of factors, such as age, body weight, general health, diet, sex, composition of the present disclosure to be administered, route of administration, severity of the condition being treated, and clinical effect to be achieved. The dose of the composition of the present disclosure also will be determined by the existence, nature and extent of any adverse side effects that might accompany the administration of a particular peptide of the present disclosure.

Targeted Forms

One of ordinary skill in the art will readily appreciate that the peptides of the compositions of the present disclosures can be modified in any number of ways, such that the therapeutic or prophylactic efficacy of the peptide (GIP agonist peptide, glucagon antagonist peptide, or both) is increased through the modification. For instance, the peptide of the present disclosure (GIP agonist peptide, glucagon antagonist peptide, or both) can be conjugated either directly or indirectly through a linker to a targeting moiety. The practice of conjugating compounds, e.g., peptides described herein (GIP agonist peptide, glucagon antagonist peptide, or both), to targeting moieties is known in the art. See, for instance, Wadhwa et al., *J Drug Targeting*, 3, 111-127 (1995) and U.S. Pat. No. 5,087,616. The term "targeting moiety" as used herein, refers to any molecule or agent that specifically recognizes and binds to a cell-surface receptor, such that the targeting moiety directs the delivery of the peptide of the present disclosures (GIP agonist peptide, glucagon antagonist peptide, or both) to a population of cells on which surface the receptor (the glucagon receptor, the GIP receptor, the GLP-1 receptor) is expressed. Targeting moieties include, but are not limited to, antibodies, or fragments thereof, peptides, hormones, growth factors, cytokines, and any other natural or non-natural ligands, which bind to cell surface receptors (e.g., Epithelial Growth Factor Receptor (EGFR), T-cell receptor (TCR), B-cell receptor (BCR), CD28, Platelet-derived Growth Factor Receptor (PDGF), nicotinic acetylcholine receptor (nAChR), etc.). As used herein a "linker" is a bond, molecule or group of molecules that binds two separate entities to one another. Linkers may provide for optimal spacing of the two entities or may further supply a labile linkage that allows the two entities to be separated from each other. Labile linkages include photocleavable groups, acid-labile moieties, base-labile moieties and enzyme-cleavable groups. The term "linker" in some embodiments refers to any agent or molecule that bridges the peptide of the present disclosures to the targeting moiety. One of ordinary skill in the art recognizes that sites on the peptide of the present disclosures (GIP agonist peptide, glucagon antagonist peptide, or both), which are not necessary for the function of the peptide of the present disclosures (GIP agonist peptide, glucagon antagonist peptide, or both), are ideal sites for attaching a linker and/or a targeting moiety, provided that the linker and/or targeting moiety, once attached to the peptide of the present disclosures (GIP agonist peptide, glucagon antagonist peptide, or both), do(es) not interfere with the function of the peptide of the present disclosures (GIP agonist peptide, glucagon antagonist peptide, or both), i.e., the ability to stimulate cAMP secretion from cells, to treat diabetes or obesity.

Controlled Release Formulations and Time of Administration

Alternatively, the peptides described herein (GIP agonist peptide, glucagon antagonist peptide, or both) can be modified into a depot form, such that the manner in which the peptide of the present disclosures is released into the body to which it is administered is controlled with respect to time and location within the body (see, for example, U.S. Pat. No. 4,450,150). Depot forms of peptide of the present disclosures (GIP agonist peptide, glucagon antagonist peptide, or both) can be, for example, an implantable composition comprising the peptide of the present disclosures and a porous or non-porous material, such as a polymer, wherein the peptide of the present disclosures is encapsulated by or diffused throughout the material and/or degradation of the non-porous material. The depot is then implanted into the desired location within the body and the peptide of the present disclosures (GIP agonist peptide, glucagon antagonist peptide, or both) are released from the implant at a predetermined rate.

The pharmaceutical composition in certain aspects is modified to have any type of in vivo release profile. In some aspects, the pharmaceutical composition is an immediate release, controlled release, sustained release, extended release, delayed release, or bi-phasic release formulation. Methods of formulating peptides for controlled release are known in the art. See, for example, Qian et al., *J Pharm* 374: 46-52 (2009) and International Patent Application Publication Nos. WO 2008/130158, WO2004/033036; WO2000/032218; and WO 1999/040942.

The instant compositions may further comprise, for example, micelles or liposomes, or some other encapsulated form, or may be administered in an extended release form to provide a prolonged storage and/or delivery effect.

The disclosed pharmaceutical formulations may be administered according to any regime including, for example, daily (1 time per day, 2 times per day, 3 times per day, 4 times per day, 5 times per day, 6 times per day), every two days, every three days, every four days, every five days, every six days, weekly, bi-weekly, every three weeks, monthly, or bi-monthly.

Combinations

The peptides described herein (GIP agonist peptide, glucagon antagonist peptide, or both) may be administered alone or in combination with other therapeutic agents which aim to treat or prevent any of the diseases or medical conditions described herein. For example, the peptides described herein (GIP agonist peptide, glucagon antagonist peptide, or both) may be co-administered with (simultaneously or sequentially) an anti-diabetic or anti-obesity agent. Anti-diabetic agents known in the art or under investigation include insulin, leptin, Peptide YY (PYY), Pancreatic Peptide (PP), fibroblast growth factor 21 (FGF21), Y2Y4 receptor agonists, sulfonylureas, such as tolbutamide (Orinase), acetohexamide (Dymelor), tolazamide (Tolinase), chlorpropamide (Diabinese), glipizide (Glucotrol), glyburide (Diabeta, Micronase, Glynase), glimepiride (Amaryl), or gliclazide (Diamicron); meglitinides, such as repaglinide (Prandin) or nateglinide (Starlix); biguanides such as metformin (Glucophage) or phenformin; thiazolidinediones such as rosiglitazone (Avandia), pioglitazone (Actos), or troglitazone (Rezulin), or other PPARγ inhibitors; alpha glucosidase inhibitors that inhibit carbohydrate digestion, such as miglitol (Glyset), acarbose (Precose/Glucobay); exenatide (Byetta) or pramlintide; Dipeptidyl peptidase-4 (DPP-4) inhibitors such as vildagliptin or sitagliptin; SGLT (sodium-dependent glucose transporter 1) inhibitors; glucokinase activators (GKA); glucagon receptor antagonists (GRA); or FBPase (fructose 1,6-bisphosphatase) inhibitors.

Anti-obesity agents known in the art or under investigation include appetite suppressants, including phenethylamine type stimulants, phentermine (optionally with fenfluramine or dexfenfluramine), diethylpropion (Tenuate®), phendimetrazine (Prelu-2®, Bontril®), benzphetamine (Didrex®), sibutramine (Meridia®, Reductil®); rimonabant (Acomplia®), other cannabinoid receptor antagonists; oxyntomodulin; fluoxetine hydrochloride (Prozac); Qnexa (topiramate and phentermine), Excalia (bupropion and zonisamide) or Contrave (bupropion and naltrexone); or lipase inhibitors, similar to XENICAL (Orlistat) or Cetilistat (also known as ATL-962), or GT 389-255.

The peptides described herein (GIP agonist peptide, glucagon antagonist peptide, or both) in some embodiments are co-administered with an agent for treatment of non-alcoholic fatty liver disease or NASH. Agents used to treat non-alcoholic fatty liver disease include ursodeoxycholic acid (a.k.a., Actigall, URSO, and Ursodiol), Metformin (Glucophage), rosiglitazone (Avandia), Clofibrate, Gemfibrozil, Polymixin B, and Betaine.

The peptides described herein (GIP agonist peptide, glucagon antagonist peptide, or both) in some embodiments are co-administered with an agent for treatment of a neurodegenerative disease, e.g., Parkinson's Disease. Anti-Parkinson's Disease agents are furthermore known in the art and include, but not limited to, levodopa, carbidopa, anticholinergics, bromocriptine, pramipexole, and ropinirole, amantadine, and rasagiline.

In view of the foregoing, the present disclosures further provide pharmaceutical compositions and kits additionally comprising one of these other therapeutic agents. The additional therapeutic agent may be administered simultaneously or sequentially with the peptide of the present disclosure. In some aspects, the peptide is administered before the additional therapeutic agent, while in other aspects, the peptide is administered after the additional therapeutic agent.

Uses

Based on the information provided for the first time herein, it is contemplated that the compositions (e.g., related pharmaceutical compositions) of the present disclosures are useful for treatment of a disease or medical condition, in which e.g., the lack of activity at the GIP receptor, the GLP-1 receptor, or at both receptors, is a factor in the onset and/or progression of the disease or medical condition. Accordingly, the present disclosures provides a method of treating or preventing a disease or medical condition in a patient, wherein the disease or medical condition is a disease of medical condition in which a lack of GIP receptor activation and/or GLP-1 receptor activation is associated with the onset and/or progression of the disease of medical condition. The method comprises providing to the patient a composition or conjugate in accordance with any of those described herein in an amount effective to treat or prevent the disease or medical condition.

In some embodiments, the disease or medical condition is metabolic syndrome. Metabolic Syndrome, also known as metabolic syndrome X, insulin resistance syndrome or Reaven's syndrome, is a disorder that affects over 50 million Americans. Metabolic Syndrome is typically characterized by a clustering of at least three or more of the following risk factors: (1) abdominal obesity (excessive fat tissue in and around the abdomen), (2) atherogenic dyslipidemia (blood fat disorders including high triglycerides, low HDL cholesterol and high LDL cholesterol that enhance the accumulation of plaque in the artery walls), (3) elevated blood pressure, (4) insulin resistance or glucose intolerance, (5) prothrombotic state (e.g., high fibrinogen or plasminogen activator inhibitor-1 in blood), and (6) pro-inflammatory state (e.g., elevated C-reactive protein in blood). Other risk factors may include aging, hormonal imbalance and genetic predisposition.

Metabolic Syndrome is associated with an increased the risk of coronary heart disease and other disorders related to the accumulation of vascular plaque, such as stroke and peripheral vascular disease, referred to as atherosclerotic cardiovascular disease (ASCVD). Patients with Metabolic Syndrome may progress from an insulin resistant state in its early stages to full blown type II diabetes with further increasing risk of ASCVD. Without intending to be bound by any particular theory, the relationship between insulin resistance, Metabolic Syndrome and vascular disease may involve one or more concurrent pathogenic mechanisms including impaired insulin-stimulated vasodilation, insulin resistance-associated reduction in NO availability due to enhanced oxidative stress, and abnormalities in adipocyte-derived hormones such as adiponectin (Lteif and Mather, Can. J. Cardiol. 20 (suppl. B):66B-76B (2004)).

According to the 2001 National Cholesterol Education Program Adult Treatment Panel (ATP III), any three of the following traits in the same individual meet the criteria for Metabolic Syndrome: (a) abdominal obesity (a waist circumference over 102 cm in men and over 88 cm in women); (b) serum triglycerides (150 mg/dl or above); (c) HDL cholesterol (40 mg/dl or lower in men and 50 mg/dl or lower in women); (d) blood pressure (130/85 or more); and (e) fasting blood glucose (110 mg/dl or above). According to the World Health Organization (WHO), an individual having high insulin levels (an elevated fasting blood glucose or an elevated post meal glucose alone) with at least two of the following criteria meets the criteria for Metabolic Syndrome: (a) abdominal obesity (waist to hip ratio of greater than 0.9, a body mass index of at least 30 kg/m2, or a waist measurement over 37 inches); (b) cholesterol panel showing a triglyceride level of at least 150 mg/dl or an HDL cholesterol lower than 35 mg/dl; (c) blood pressure of 140/90 or more, or on treatment for high blood pressure).

(Mathur, Ruchi, "Metabolic Syndrome," ed. Shiel, Jr., William C., MedicineNet.com, May 11, 2009).

For purposes herein, if an individual meets the criteria of either or both of the criteria set forth by the 2001 National Cholesterol Education Program Adult Treatment Panel or the WHO, that individual is considered as afflicted with Metabolic Syndrome.

Without being bound to any particular theory, compositions and conjugates described herein are useful for treating Metabolic Syndrome. Accordingly, the invention provides a method of preventing or treating Metabolic Syndrome, or reducing one, two, three or more risk factors thereof, in a subject, comprising providing to the subject a composition described herein in an amount effective to prevent or treat Metabolic Syndrome, or the risk factor thereof.

In some embodiments, the method treats a hyperglycemic medical condition. In certain aspects, the hyperglycemic medical condition is diabetes, diabetes mellitus type I, diabetes mellitus type II, or gestational diabetes, either insulin-dependent or non-insulin-dependent. In some aspects, the method treats the hyperglycemic medical condition by reducing one or more complications of diabetes including nephropathy, retinopathy and vascular disease.

In some aspects, the disease or medical condition is obesity. In some aspects, the obesity is drug-induced obesity. In some aspects, the method treats obesity by preventing or reducing weight gain or increasing weight loss in the patient. In some aspects, the method treats obesity by reducing appetite, decreasing food intake, lowering the levels of fat in the patient, or decreasing the rate of movement of food through the gastrointestinal system.

Because obesity is associated with the onset or progression of other diseases, the methods of treating obesity are further useful in methods of reducing complications associated with obesity including vascular disease (coronary artery disease, stroke, peripheral vascular disease, ischemia reperfusion, etc.), hypertension, onset of diabetes type II, hyperlipidemia and musculoskeletal diseases. The present disclosures accordingly provides methods of treating or preventing these obesity-associated complications.

In some embodiments, the disease or medical condition is Nonalcoholic fatty liver disease (NAFLD). NAFLD refers to a wide spectrum of liver disease ranging from simple fatty liver (steatosis), to nonalcoholic steatohepatitis (NASH), to cirrhosis (irreversible, advanced scarring of the liver). All of the stages of NAFLD have in common the accumulation of fat (fatty infiltration) in the liver cells (hepatocytes). Simple fatty liver is the abnormal accumulation of a certain type of fat, triglyceride, in the liver cells with no inflammation or scarring. In NASH, the fat accumulation is associated with varying degrees of inflammation (hepatitis) and scarring (fibrosis) of the liver. The inflammatory cells can destroy the liver cells (hepatocellular necrosis). In the terms "steatohepatitis" and "steatonecrosis", steato refers to fatty infiltration, hepatitis refers to inflammation in the liver, and necrosis refers to destroyed liver cells. NASH can ultimately lead to scarring of the liver (fibrosis) and then irreversible, advanced scarring (cirrhosis). Cirrhosis that is caused by NASH is the last and most severe stage in the NAFLD spectrum. (Mendler, Michel, "Fatty Liver: Nonalcoholic Fatty Liver Disease (NAFLD) and Nonalcoholic Steatohepatitis (NASH)," ed. Schoenfield, Leslie J., MedicineNet.com, Aug. 29, 2005).

Alcoholic Liver Disease, or Alcohol-Induced Liver Disease, encompasses three pathologically distinct liver diseases related to or caused by the excessive consumption of alcohol: fatty liver (steatosis), chronic or acute hepatitis, and cirrhosis. Alcoholic hepatitis can range from a mild hepatitis, with abnormal laboratory tests being the only indication of disease, to severe liver dysfunction with complications such as jaundice (yellow skin caused by bilirubin retention), hepatic encephalopathy (neurological dysfunction caused by liver failure), ascites (fluid accumulation in the abdomen), bleeding esophageal varices (varicose veins in the esophagus), abnormal blood clotting and coma. Histologically, alcoholic hepatitis has a characteristic appearance with ballooning degeneration of hepatocytes, inflammation with neutrophils and sometimes Mallory bodies (abnormal aggregations of cellular intermediate filament proteins). Cirrhosis is characterized anatomically by widespread nodules in the liver combined with fibrosis. (Worman, Howard J., "Alcoholic Liver Disease", Columbia University Medical Center website).

Without being bound to any particular theory, the compositions and conjugates described herein are useful for the treatment of Alcoholic Liver Disease, NAFLD, or any stage thereof, including, for example, steatosis, steatohepatitis, hepatitis, hepatic inflammation, NASH, cirrhosis, or complications thereof. Accordingly, the present disclosures provides a method of preventing or treating Alcoholic Liver Disease, NAFLD, or any stage thereof, in a subject comprising providing to a subject a composition described herein in an amount effective to prevent or treat Alcoholic Liver Disease, NAFLD, or the stage thereof. Such treatment methods include reduction in one, two, three or more of the following: liver fat content, incidence or progression of cirrhosis, incidence of hepatocellular carcinoma, signs of inflammation, e.g., abnormal hepatic enzyme levels (e.g., aspartate aminotransferase AST and/or alanine aminotransferase ALT, or LDH), elevated serum ferritin, elevated serum bilirubin, and/or signs of fibrosis, e.g., elevated TGF-beta levels. In certain embodiments, the compositions are used treat patients who have progressed beyond simple fatty liver (steatosis) and exhibit signs of inflammation or hepatitis. Such methods may result, for example, in reduction of AST and/or ALT levels.

GLP-1 and exendin-4 have been shown to have some neuroprotective effect. The present disclosures also provides uses of the compositions described herein in treating neurodegenerative diseases, including but not limited to Alzheimer's disease, Parkinson's disease, Multiple Sclerosis, Amylotrophic Lateral Sclerosis, other demyelination related disorders, senile dementia, subcortical dementia, arteriosclerotic dementia, AIDS-associated dementia, or other dementias, a central nervous system cancer, traumatic brain injury, spinal cord injury, stroke or cerebral ischemia, cerebral vasculitis, epilepsy, Huntington's disease, Tourette's syndrome, Guillain Barre syndrome, Wilson disease, Pick's disease, neuroinflammatory disorders, encephalitis, encephalomyelitis or meningitis of viral, fungal or bacterial origin, or other central nervous system infections, prion diseases, cerebellar ataxias, cerebellar degeneration, spinocerebellar degeneration syndromes, Friedreichs ataxia, ataxia telangiectasia, spinal dysmyotrophy, progressive supranuclear palsy, dystonia, muscle spasticity, tremor, retinitis pigmentosa, striatonigral degeneration, mitochondrial encephalo-myopathies, neuronal ceroid lipofuscinosis, hepatic encephalopathies, renal encephalopathies, metabolic encephalopathies, toxin-induced encephalopathies, and radiation-induced brain damage.

In some embodiments, the compositions are used in conjunction with parenteral administration of nutrients to non-diabetic patients in a hospital setting, e.g., to patients receiving parenteral nutrition or total parenteral nutrition.

Nonlimiting examples include surgery patients, patients in comas, patients with digestive tract illness, or a nonfunctional gastrointestinal tract (e.g. due to surgical removal, blockage or impaired absorptive capacity, Crohn's disease, ulcerative colitis, gastrointestinal tract obstruction, gastrointestinal tract fistula, acute pancreatitis, ischemic bowel, major gastrointestinal surgery, certain congenital gastrointestinal tract anomalies, prolonged diarrhea, or short bowel syndrome due to surgery, patients in shock, and patients undergoing healing processes often receive parenteral administration of carbohydrates along with various combinations of lipids, electrolytes, minerals, vitamins and amino acids. The compositions comprising the GIP agonist peptide and glucagon antagonist peptide, as described herein, and the parenteral nutrition composition can be administered at the same time, at different times, before, or after each other, provided that the composition is exerting the desired biological effect at the time that the parenteral nutrition composition is being digested. For example, the parenteral nutrition may be administered, 1, 2 or 3 times per day, while the composition is administered once every other day, three times a week, two times a week, once a week, once every 2 weeks, once every 3 weeks, or once a month.

As used herein, the terms "treat," and "prevent" as well as words stemming therefrom, do not necessarily imply 100% or complete treatment or prevention. Rather, there are varying degrees of treatment or prevention of which one of ordinary skill hi the art recognizes as having a potential benefit or therapeutic effect. In this respect, the methods of the present disclosures can provide any amount of any level of treatment or prevention of a disease or medical condition in a mammal. Furthermore, the treatment or prevention provided by the method can include treatment or prevention of one or more conditions or symptoms of the disease or medical condition. For example, with regard to methods of treating obesity, the method in some embodiments, achieves a decrease in food intake by or fat levels in a patient. Also, for purposes herein, "prevention" can encompass delaying the onset of the disease, or a symptom or condition thereof.

With regard to the above methods of treatment, the patient is any host. In some embodiments, the host is a mammal. As used herein, the term "mammal" refers to any vertebrate animal of the mammalia class, including, but not limited to, any of the monotreme, marsupial, and placental taxas. In some embodiments, the mammal is one of the mammals of the order Rodentia, such as mice and hamsters, and mammals of the order Logomorpha, such as rabbits. In certain embodiments, the mammals are from the order Carnivora, including Felines (cats) and Canines (dogs). In certain embodiments, the mammals are from the order Artiodactyla, including Bovines (cows) and S wines (pigs) or of the order Perssodactyla, including Equines (horses). In some instances, the mammals are of the order Primates, Ceboids, or Simoids (monkeys) or of the order Anthropoids (humans and apes). In particular embodiments, the mammal is a human.

Kits

The present disclosures further provide kits comprising a GIP agonist peptide and glucagon antagonist peptide, wherein each of the GIP agonist peptide and glucagon antagonist peptide are in accordance with the teachings found herein. Accordingly, in some embodiments, the kit comprises a GIP agonist peptide which exhibits at least 0.1% activity of native GIP at the GIP receptor and a glucagon antagonist peptide which exhibits at least 60% inhibition of the maximum response achieved by glucagon at the glucagon receptor.

In some aspects, the GIP agonist peptide is packaged separately from the glucagon antagonist peptide. For example, the kit may include two separate containers, e.g., vials, tubes, bottles, single or multi-chambered pre-filled syringes, cartridges, infusion pumps (external or implantable), jet injectors, pre-filled pen devices and the like, each of which contain one of the GIP agonist peptide and glucagon antagonist peptide. In alternative aspects, the GIP agonist peptide is packaged together with the glucagon antagonist peptide, e.g., the GIP agonist peptide is conjugated to the glucagon antagonist peptide and the conjugate is provided in the kit in a single container, such as any of those described herein.

In some embodiments, the GIP agonist peptide, the glucagon antagonist peptide, or both are provided in the kit as a lyophilized form or in an aqueous solution.

The kits in some embodiments comprise instructions for use. The instructions in some aspects include instructions for simultaneous and separate co-administration of the GIP agonist peptide and glucagon antagonist peptide.

In one embodiment the kit is provided with a device for administering the composition to a patient, e.g., syringe needle, pen device, jet injector or other needle-free injector. In accordance with one embodiment the device of the kit is an aerosol dispensing device, wherein the composition is prepackaged within the aerosol device. In another embodiment the kit comprises a syringe and a needle, and in one embodiment the sterile composition is prepackaged within the syringe.

In some embodiments, the kit comprises a pharmaceutically acceptable carrier, such as any of those described herein.

The following examples are given merely to illustrate the present invention and not in any way to limit its scope.

EXAMPLES

Example 1

Synthesis of Peptide Fragments of Glucagon
Materials:

All peptides described herein in the EXAMPLES were amidated unless specified otherwise.

MBHA resin (4-methylbenzhydrylamine polystyrene resin was used during peptide synthesis. MBHA resin, 100-180 mesh, 1% DVB cross-linked polystyrene; loading of 0.7-1.0 mmol/g), Boc-protected and Fmoc protected amino acids were purchased from Midwest Biotech. The solid phase peptide syntheses using Boc-protected amino acids were performed on an Applied Biosystem 430A Peptide Synthesizer. Fmoc protected amino acid synthesis was performed using the Applied Biosystems Model 433 Peptide Synthesizer.

Peptide Synthesis (Boc Amino Acids/HF Cleavage):

Synthesis of these analogs was performed on the Applied Biosystem Model 430A Peptide Synthesizer. Synthetic peptides were constructed by sequential addition of amino acids to a cartridge containing 2 mmol of Boc protected amino acid. Specifically, the synthesis was carried out using Boc DEPBT-activated single couplings. At the end of the coupling step, the peptidyl-resin was treated with TFA to remove the N-terminal Boc protecting group. It was washed repeatedly with DMF and this repetitive cycle was repeated for the desired number of coupling steps. After the assembly, the sidechain protection, Fmoc, was removed by 20% piperidine treatment and acylation was conducted using DIC.

The peptidyl-resin at the end of the entire synthesis was dried by using DCM, and the peptide was cleaved from the resin with anhydrous HF.

For the lactamization, orthogonal protecting groups were selected for Glu and Lys (e.g., Glu(Fm), Lys(Fmoc)). After removal of the protecting groups and before HF cleavage, cyclization was performed as described previously (see, e.g., International Patent Application Publication No. WO2008/101017).

HF Treatment of the Peptidyl-Resin

The peptidyl-resin was treated with anhydrous HF, and this typically yielded approximately 350 mg (~50% yield) of a crude deprotected-peptide. Specifically, the peptidyl-resin (30 mg to 200 mg) was placed in the hydrogen fluoride (HF) reaction vessel for cleavage. 500 µL of p-cresol was added to the vessel as a carbonium ion scavenger. The vessel was attached to the HF system and submerged in the methanol/dry ice mixture. The vessel was evacuated with a vacuum pump and 10 ml of HF was distilled to the reaction vessel. This reaction mixture of the peptidyl-resin and the HF was stirred for one hour at 0° C., after which a vacuum was established and the HF was quickly evacuated (10-15 min). The vessel was removed carefully and filled with approximately 35 ml of ether to precipitate the peptide and to extract the p-cresol and small molecule organic protecting groups resulting from HF treatment. This mixture was filtered utilizing a teflon filter and repeated twice to remove all excess cresol. This filtrate was discarded. The precipitated peptide dissolves in approximately 20 ml of 10% acetic acid (aq). This filtrate, which contained the desired peptide, was collected and lyophilized.

An analytical HPLC analysis of the crude solubilized peptide was conducted under the following conditions [4.6× 30 mm Xterra C8, 1.50 mL/min, 220 nm, A buffer 0.1% TFA/10% ACN, B buffer 0.1% TFA/100% ACN, gradient 5-95% B over 15 minutes]. The extract was diluted twofold with water and loaded onto a 2.2×25 cm Vydac C4 preparative reverse phase column and eluted using an acetonitrile gradient on a Waters HPLC system (A buffer of 0.1% TFA/10% ACN, B buffer of 0.1% TFA/10% CAN and a gradient of 0-100% B over 120 minutes at a flow of 15.00 ml/min. HPLC analysis of the purified peptide demonstrated greater than 95% purity and electrospray ionization mass spectral analysis was used to confirm the identity of the peptide.

Peptide Acylation

Acylated peptides were prepared as follows. Peptides were synthesized on a solid support resin using either a CS Bio 4886 Peptide Synthesizer or Applied Biosystems 430A Peptide Synthesizer. In situ neutralization chemistry was used as described by Schnolzer et al., Int. J. Peptide Protein Res. 40: 180-193 (1992). For acylated peptides, the target amino acid residue to be acylated (e.g., position ten, relative to the amino acid position numbering of SEQ ID NO: 1) was substituted with an N ε-FMOC lysine residue. Treatment of the completed N-terminally BOC protected peptide with 20% piperidine in DMF for 30 minutes removed FMOC/formyl groups. Coupling to the free ε-amino Lys residue was achieved by coupling a ten-fold molar excess of either an FMOC-protected spacer amino acid (ex. FMOC-Glu-OtBu) or acyl chain (ex. $CH_3(CH_2)_{14}$—COOH) and PyBOP or DEPBT coupling reagent in DMF/DIEA. Subsequent removal of the spacer amino acid's FMOC group is followed by repetition of coupling with an acyl chain. Final treatment with 100% TFA resulted in removal of any side chain protecting groups and the N-terminal BOC group. Peptide resins were neutralized with 5% DIEA/DMF, dried, and then cleaved from the support using HF/p-cresol, 95:5, at 0° C. for one hour. Following ether extraction, a 5% HOAc solution was used to solvate the crude peptide. A sample of the solution was then verified to contain the correct molecular weight peptide by ESI-MS. Correct peptides were purified by RP-HPLC using a linear gradient of 10% CH3CN/0.1% TFA to 0.1% TFA in 100% CH3CN. A Vydac C18 22 mm×250 mm protein column was used for the purification. Acylated peptide analogs generally completed elution by a buffer ratio of 20:80. Portions were pooled together and checked for purity on an analytical RP-HPLC. Pure fractions were lyophilized yielding white, solid peptides.

If a peptide comprised a lactam bridge and target residues to be acylated, acylation is carried out as described above upon addition of that amino acid to the peptide backbone.

Peptide PEGylation

For peptide PEGylation, 40 kDa methoxy poly(ethylene glycol) idoacetamide (NOF) was reacted with a molar equivalent of peptide in 7M Urea, 50 mM Tris-HCl buffer using the minimal amount of solvent needed to dissolve both peptide and PEG into a clear solution (generally less than 2 mL for a reaction using 2-3 mg peptide). Vigorous stirring at room temperature commenced for 4-6 hours and the reaction analyzed by analytical RP-HPLC. PEGylated products appeared distinctly from the starting material with decreased retention times. Purification was performed on a Vydac C4 column with conditions similar to those used for the initial peptide purification. Elution occurred around buffer ratios of 50:50. Fractions of pure PEGylated peptide were found and lyophilized. Yields were above 50%, varying per reaction.

Analysis Using Mass Spectrometry

The mass spectra were obtained using a Sciex API-III electrospray quadrapole mass spectrometer with a standard ESI ion source. Ionization conditions that were used are as follows: ESI in the positive-ion mode; ion spray voltage, 3.9 kV; orifice potential, 60 V. The nebulizing and curtain gas used was nitrogen flow rate of 0.9 L/min. Mass spectra were recorded from 600-1800 Thompsons at 0.5 Th per step and 2 msec dwell time. The sample (about 1 mg/mL) was dissolved in 50% aqueous acetonitrile with 1% acetic acid and introduced by an external syringe pump at the rate of 5 µL/min.

When the peptides were analyzed in PBS solution by ESI MS, they were first desalted using a ZipTip solid phase extraction tip containing 0.6 µL C4 resin, according to instructions provided by the manufacturer (Millipore Corporation, Billerica, Mass., see the Millipore website of the world wide web at millipore.com/catalogue.nsf/docs/C5737).

High Performance Liquid Chromatography (HPLC) Analysis:

Preliminary analyses were performed with these crude peptides to get an approximation of their relative conversion rates in Phosphate Buffered Saline (PBS) buffer (pH, 7.2) using high performance liquid chromatography (HPLC) and MALDI analysis. The crude peptide samples were dissolved in the PBS buffer at a concentration of 1 mg/ml. 1 ml of the resulting solution was stored in a 1.5 ml HPLC vial which was then sealed and incubated at 37° C. Aliquots of 100 µl were drawn out at various time intervals, cooled to room temperature and analyzed by HPLC.

The HPLC analyses were performed using a Beckman System Gold Chromatography system using a UV detector at 214 nm. HPLC analyses were performed on a 150 mm×4.6 mm C18 Vydac column. The flow rate was 1 ml/min. Solvent A contained 0.1% TFA in distilled water, and solvent B contained 0.1% TFA in 90% CH3CN. A linear gradient was employed (40% to 70% B in 15 minutes). The data were collected and analyzed using Peak Simple Chromatography software.

The initial rates of hydrolysis were used to measure the rate constant for the dissociation of the respective prodrugs. The concentrations of the prodrug and the drug were estimated from their peak areas respectively. The first order dissociation rate constants of the prodrugs were determined by plotting the logarithm of the concentration of the prodrug at various time intervals. The slope of this plot gives the rate constant 'k'. The half lives of the degradation of the various prodrugs were then calculated by using the formula t½=0.693/k.

In specific embodiments, the following procedures can be used:

General Peptide Synthesis Protocol with Boc-Chemistry Strategy:

Glucagon analogs were synthesized using HBTU-activated "Fast Boc" single coupling starting from 0.2 mmole of MBHA resin or first amino acid attached Pam resin on a modified Applied Biosystem 430A peptide synthesizer. Boc amino acids and HBTU were obtained from Midwest Biotech (Fishers, Ind.). General side chain protecting groups used were: Arg(Tos), Asn(Xan), Asp(OcHex), Cys(pMe-Bzl), His(Bom), Lys(2Cl-Z), Ser(OBzl), Thr(OBzl), Tyr (2Br-Z), and Trp(CHO). Boc-Glu(OFm)-OH and Boc-Lys(Fmoc)-OH (Chem-Impex, Wood dale, IL) were used in the lactam-bridge formation sites. The N-terminal 3-phenyllactic acid (PLA) (Aldrich, Milwaukee, Wis.) was coupled manually by BEPBT (3-(Diethoxy-phosphoryloxy)-3H-benzo[d][1,2,3] triazin-4-one (Synchem Inc., Aurora, Ohio) after the automated solid phase synthesis.

After peptide solid phase synthesis, each completed peptidyl resin was treated with 20% piperidine/DMF to remove the Fmoc groups. For the lactam-bridge formation, usually 299 mg (1 mmole, 5-fold) BEPBT were added in 10% DIEA/DMF and reacted for 2~4 h until ninhydrin test shown negative.

Peptides were cleaved by liquid hydrogen fluoride cleavages performed in the presence of p-cresol and dimethyl sulfide. The cleavage was run for 1 hour in an ice bath using an HF apparatus (Penninsula Labs). After evaporation of the HF, the residue was suspended in diethyl ether and the solid materials were filtered and washed with ether. Each peptide was extracted into 30-70 ml aqueous acetic acid and diluted with water and lyophilized. Crude peptide was analyzed by analytical HPLC and peptide molecule weight was checked by ESI or MALDI-TOF mass spectrometry. Peptides were then purified by the general HPLC purification procedure.

General Peptide Synthesis Protocol with Fmoc-Chemistry Strategy:

Peptides were synthesized on an ABI 433A automated peptide synthesizer using standard Fmoc chemistry with Rink MBHA amide resin or first amino acid attached Wang resin (Novabiochem, San Diego, Calif.) using DIC/HOBT as coupling reagent. 3-phenyllactic acid (PLA) was coupled manually by BEPBT after the automated peptide synthesis. The side chain protecting groups of $N^\alpha$-Fmoc [N-(9-fluorenyl)methoxycarbonyl]amino acids were as follows: Arg, Pmc; Asp, OtBu; Cys, Trt; Gln, Trt; His, Trt; Lys, Boc; Ser, tBu, Tyr, tBu; and Trp, Boc (Pmc=2,2,5,7,8-pentamethylchoman-6-sulfonyl, OtBu=tert-butyl ester, Trt=trityl, Boc=tert-butyloxycarbonyl, and tBu=tert-butyl ester). Fmoc-Glu(O-2-PhiPr)-OH and Fmoc-Lys(Mmt)-OH (Novabiochem, San Diego, Calif.) were incorporated in the lactam-bridge formation sites.

After solid phase synthesis, the 2-phenylisopropyl (2-PhiPr) group on the Glu and the 4-methoxytrityl (Mmt) group on the Lys were removed by flashing 1% TFA/DCM though the peptidyl resin. For the lactam-bridge formation, usually 150 mg (0.5 mmole, 5-fold) BEPBT were added in 10% DIEA/DMF and reacted for 2~4 h until ninhydrin test shown negative.

Peptides were cleaved from the resin with cleavage cocktail containing 85% TFA, 5% phenol, 5% water and 5% thioanisole (2.5% EDT was added when peptide contains Cysteine). Crude peptides were precipitated in ether, centrifuged, and lyophilized. Peptides were then analyzed by analytical HPLC and checked by ESI or MALDI-TOF mass spectrometry. Peptides were purified by the general HPLC purification procedure.

General Analytical HPLC Procedure:

Analytical HPLC was performed on a Beckman System Gold HPLC system with a ZORBAX SB-C8 column (0.46×5 cm, 51 μm, Agilent) with a gradient elution at a flow rate of 1.0 mL/min and monitored at 214 nm. The gradients were set up as 10% B to 80% B over 10 min and then 10% B for 5 min. Buffer A=0.1% TFA and B=0.1% TFA/90% acetonitrile.

General Preparative HPLC Purification Procedure:

If not specifically noted, the peptides were usually purified on a Waters 600E connected 486 monitor systems with semi-prepare HPLC column (ZORBAX SB-C8, 21.2×250 mm, Agilent) monitored at 214 nm or 230 nM. Buffer A=0.1% TFA/10% acetonitrile and B=0.1% TFA/90% acetonitrile. The gradients used for the purification were 0-30% B over 40 min, then 30-50% B over 30 min at a flow rate of 12 ml/min if not specifically noted. Fractions were analyzed by analytical HPLC and checked by mass spectrometry. The fractions over 90% pure were collected, lyophilized and stored. The fractions with purity between 60-90% were combined, lyophilized and purified again.

General Pegylation Protocol: (Cys-Maleimido)

Typically, the glucagon Cys analog is dissolved in phosphate buffered saline (5-10 mg/ml) and 0.01-Methylenediamine tetraacetic acid is added (10-15% of total volume). Excess (1.2~2-fold) maleimido methoxy-polyethylene glycol (MAL-m-dPEG) reagent is added and the reaction stirred at room temp while monitoring reaction progress by HPLC. After 2~12 h, the reaction mixture, is acidified and loaded onto a preparative reverse phase column for purification using 0.1% TFA/acetonitrile gradients. The appropriate fractions were combined and lyophilized to give the desired pegylated derivatives.

For peptides that exhibit low solubility in PBS, the peptides were dissolved in 25% acetonitrile water or 4~6M urea buffer with 50~100 mM Tris (adjust pH 8.0~8.5) and reacted with PEG reagents.

Specific examples of compounds synthesized by the methods described above are provided as follows:

Synthesis of [PLA6, D9, E16K20(lactam), D28]Glucagon (6-29) Amide

A peptide sequence TSDYSKYLDERRAKD-FVQWLMDT (SEQ ID NO: 1249) was first solid phase synthesized on ABI 433A automated peptide synthesizer using 0.1 mmole Fmoc/HOBT/DCC chemistry program with 0.1 mmole Rink MBHA amide resin using DIC/HOBT as coupling reagent. The following Fmoc amino acid were used: Ala, Arg(Pmc), Asp(OtBu), Asn(Trt), Glu(O-2-PhiPr), Gln(Trt), Leu, Lys(Boc), Lys(Mmt), Met, PLA, Ser(tBu), Thr(tBu), Trp(Boc), Tyr(tBu), and Val. After the automated synthesis, the peptidyl resin was coupled manually with 3-phenyllactic acid (83 mg, 0.5 mmole) and DEPBT (150 mg, 0.5 mmole) in 4 ml 5% DIEA/DMF for about 2 h to obtain the peptidyl resin with the following sequence: HO-PLA-Thr-Ser-Asp-Tyr-Ser-Lys-Tyr-Leu-Asp-Glu-Arg-Arg-Ala-Lys-Asp-Phe-Val-Gln-Trp-Leu-Met-Asp-Thr-NH$_2$ (SEQ ID NO: 1206).

Peptidyl resin was flashed with 50 ml 1% TFA/DCM in 5~10 min and washed with DCM, 5% DIEA/DMF and DMF. The peptidyl resin was then treated with 150 mg (0.5 mmole, 5-fold) DEPBT in 10% DIEA/DMF for 2~4 h until ninhydrin test shown negative.

Peptidyl resin was treated with 8.5 ml TFA with addition of 0.5 g phenol, 0.5 ml water and 0.5 ml thioanisole at room temperature for about 2 h. The peptide dissolved in TFA was filtered and 40 ml ether was added to precipitate the peptide. The crude peptide were centrifuged, dissolved in aqueous acetic acid and lyophilized to get 150~250 mg crude peptide. After purification 20~30 mg (10~15% yield totally) peptide with 95% purity was obtained. The peptide was analyzed in general analytical HPLC showing retention time as 7.63 min and ESI-MS analysis demonstrated the desired mass of 2997.0 corresponding with the peptide molecular weight 2997.3.

Similar procedures were used to synthesize the following peptides: [PLA6, E9, E16K20(lactam)]glucagon(6-39) amide with analytical HPLC 7.17 min and ESI-MS 3444.5 corresponding the calculated MW 3845.2; [PLA6, D9, K12E16(lactam), D28]glucagon(6-29) amide with analytical HPLC 7.71 min and ESI-MS 2997.0 corresponding the calculated MW 2997.3; [PLA6, E9, K12E16(lactam)]glucagon(6-39) amide with analytical HPLC 7.27 min and ESI-MS 3845.5 corresponding the calculated MW 3845.2; [PLA6, D9, E16K20(lactam), C24, D28]glucagon(6-29) amide with analytical HPLC 7.85 min and ESI-MS 2972.0 corresponding the calculated MW 2972.3; [PLA6, D9, K12E16(lactam), C24, D28]glucagon(6-29) amide with analytical HPLC 7.83 min and ESI-MS 2971.5 corresponding the calculated MW 2972.3; [PLA6, D9, E16K20(lactam), D28, C40]glucagon(6-40) amide with analytical HPLC 7.13 min and MALDI-MS 3935.7 corresponding the calculated MW 3935.3.

Synthesis of [PLA6, D9, E16K20(Lactam), C24(20K), D28]Glucagon (6-29) Amide 15 mg (0.005 mmole) [PLA6, D9, E16K20(lactam), C24, D28]glucagon (6-29) amide and 120 mg (0.006 mmole) 20K mPEG-MAL(MW~20k, Chirotech Technology Ltd., Cambs CB4 0WG, German) were dissolved in 9 ml 25% acetonitrile water and about 0.5~1 ml 1M Tris base buffer (adjust pH to 8.0~8.5). The reaction was stirred at room temperature and the progress of the reaction was monitored by analytical HPLC. After no initial product was detected on HPLC (2~6 h), the reaction mixture was directly purified by preparative HPLC. The fractions were checked by analytical HPLC at 214 nm and also measured by UV at 280 nm. The fractions with 90% HPLC purity and also with high absorption (A280 nm=1.0~2.0) in UV measurement were combined and lyophilized. About 60~80 mg [PLA6, D9, E16K20(lactam), C24(20K), D28]glucagon (6-29) amide can be obtained which analytical HPLC analysis shown retention time as 8.5~8.6 min and MALDI-MS shown broad mass spectrometry at 22K~24K.

Similar procedures were used to synthesize [PLA6, D9, K12E16(lactam), C24(20K), D28]glucagon (6-29) amide and [PLA6, D9, E16K20(lactam), D28, C40(20K)]glucagon (6-40) amide.

Synthesis of Dimer[PLA6, D9, E16K20(Lactam), C24, D28]Glucagon (6-29) Amide 20 mg (0.00673 mmole) [PLA6, D9, E16K20(lactam), C24, D28]glucagon (6-29) amide was dissolved in 6 ml PBS buffer, 0.5~1 ml 1M Tris base (adjust pH 8.0~8.5) and 3 ml DMSO. The reaction mixture was stirred in an open air container and monitored by analytical HPLC every 2 h. After the initial product (HPLC RT 7.85 min) was gone and the dimer product (HPLC RT 7.96 min) was the dominate product (~24 h), the mixture was diluted with 0.1% TFA10% acetonitrile water and directly purified by preparative HPLC. After lyophilized about 6-10 mg [PLA6, D9, E16K20(lactam), C24, D28]glucagon (6-29) amide was obtained with ESI-MS 5942.0 corresponding the calculated MW 5942.6.

Synthesis of Lactam-Bridge Depsipeptide [Aib2, E3, Thr5-O-PLA6, E16K20(Lactam), D28]G(2-29) Amide A peptidyl resin with sequence HO-PLA-TSDYSKY-LDERRAKDFVQWLMDT [PLA6, E16, K20, D28]glucagon(6-29) (SEQ ID NO: 1333) was synthesized by solid-phase Boc-chemistry using an ABI 430A automated peptide synthesizer with 0.2 mmole MBHA amide resin and DEPBT as coupling reagent. The following Boc amino acids were used: Ala, Arg(Tos), Asp(OcHx), Asn(Xan), Glu(OcHx), Gln(Xan), Leu, Lys(2-Cl-Z), Met, PLA, Ser(OBzl), Thr (OBzl), Trp(CHO), Tyr(2.6-di-Cl-Bzl) and Val except the glutamic acid at position 16 was incorporated with Boc-Glu (OFm)-OH and lysine at position 20 was incorporated with Boc-Lys(Fmoc)-OH. After removal of Fm and Fmoc protecting groups at position 16 and 20 with 20% piperidine in DMF, the peptidyl resin was treated with 300 mg (1 mmol) DEPBT in 10% DIEA/DMF for about 4 h to form the lactam bridge. To this lactam-bridged peptidyl resin was added a pre-activated symmetrical anhydride solution composed of Boc-Thr(OBzl)-OH (2 mmol)/DIC (1 mmol)/DMAP (0.2 mmol) in DCM and the reaction was allowed to proceed for 16 h. The remaining amino acids Boc-Gly-OH, Boc-Glu (OcHx)-OH and Boc-Aib-OH were coupled by standard Boc-chemistry again to obtain the depsipeptidyl resin of the following sequence: Aib-Glu-Gly-Thr-O-PLA-Thr-Ser-Asp-Tyr-Ser-Lys-Tyr-Leu-Asp-Glu*-Arg-Arg-Ala-Lys*-Asp-Phe-Val-Gln-Trp-Leu-Met-Asp-Thr-NH$_2$. (* are lactam bridged; SEQ ID NO: 1270).

The peptidyl resin was treated with liquid hydrogen fluoride to cleave the crude peptide from the solid support and remove all protecting groups. The depsipeptide was purified by preparative HPLC, and analyzed by MS and analytical HPLC. The purified peptide demonstrated a single peak in analytical RP-HPLC and the ESI-MS analysis yielded the desired mass of 3368.5 which corresponds with the calculated molecular weight of 3369.0 daltons.

Similar procedures were used to synthesize the other lactam-bridge depsipeptides reported in this patent.

Example 2

The ability of each peptide to induce cAMP was measured in a firefly luciferase-based reporter assay. The cAMP production that is induced is directly proportional to the glucagon fragment binding to the glucagon receptor or GIP receptor or GLP-1 receptor. HEK293 cells co-transfected with the receptor and luciferase gene linked to a cAMP responsive element were employed for the bioassay.

The cells were serum-deprived by culturing 16 hours in Dulbecco-modified Minimum Essential Medium (Invitrogen, Carlsbad, Calif.) supplemented with 0.25% Bovine Growth Serum (HyClone, Logan, Utah) and then incubated with serial dilutions of glucagon fragments for 5 hours at 37° C., 5% CO2 in 96 well poly-D-Lysine-coated "Biocoat" plates (BD Biosciences, San Jose, Calif.). At the end of the incubation, 100 μL of LucLite luminescence substrate reagent (Perkin Elmer, Wellesley, Mass.) were added to each well. The plate was shaken briefly, incubated 10 min in the dark and light output was measured on MicroBeta-1450 liquid scintillation counter (Perkin-Elmer, Wellesley, Mass.). The effective 50% concentrations (EC50) and inhibitory 50% concentrations (IC50) were calculated by using Origin software (OriginLab, Northampton, Mass.). All EC50s and IC50s are reported in the following examples in nM, unless indicated otherwise.

Example 3

The peptides listed in Table 1 were made as essentially described in Example 1 and tested for in vitro activity at each of the glucagon receptor (for antagonist activity), GLP-1 receptor (for agonist activity), and GIP receptor (for agonist activity) as essentially described in Example 2.

TABLE 1

| SEQ ID NO: | Designation | Peptide Monomer Name | Glucagon (IC50) | GLP-1 (EC50) | GIP (EC50) |
|---|---|---|---|---|---|
| 10 | A1 | PLA6, E9 G(6-29) | ~20.0 | — | — |
| 11 | A2 | PLA6, (E16K20) G(6-29) | ~20.0 | ~20.0 | — |
| 12 | A3 | HAibEGT-PLA6, (E16K20) G(1-29) | 12.0 | 3.6 | — |
| 13 | A4 | HAibEGT-PLA6, K10 (rErEC16), (E16K20) G(1-29) | 14.3 | 0.19 | — |
| 15 | A5 | HAibEGT-PLA6, (E16K20), cex, K40 (rErEC16) G(1-40) | 150.0 | 0.76 | — |
| 17 | B1 | A1, Aib2, E3 GIP(1-40) | — | — | 3.89 |
| 18 | B2 | GIP-GLP(1-40) | | | |

Specifically, the heterodimers listed in Table 2 were made by conjugating Cys24 of the "A" peptide to Lys40 of the "B" peptide using a bifunctional linker having a maleimido reactive group and an N-hydroxysuccinimide (NHS) ester reactive group flanking a methylene chain. After the "A" and "B" peptides were assembled and the side chain protecting groups (Fmoc) were removed using 20% piperidine, the bifunctional linker was conjugated to Lys40 on the "B" peptide through an acyl substitution reaction using a 4-fold excess of the linker in the presence of diisopropylethylamine (DIEA, Step 1).

Step 1

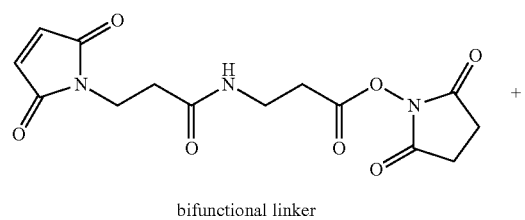

bifunctional linker

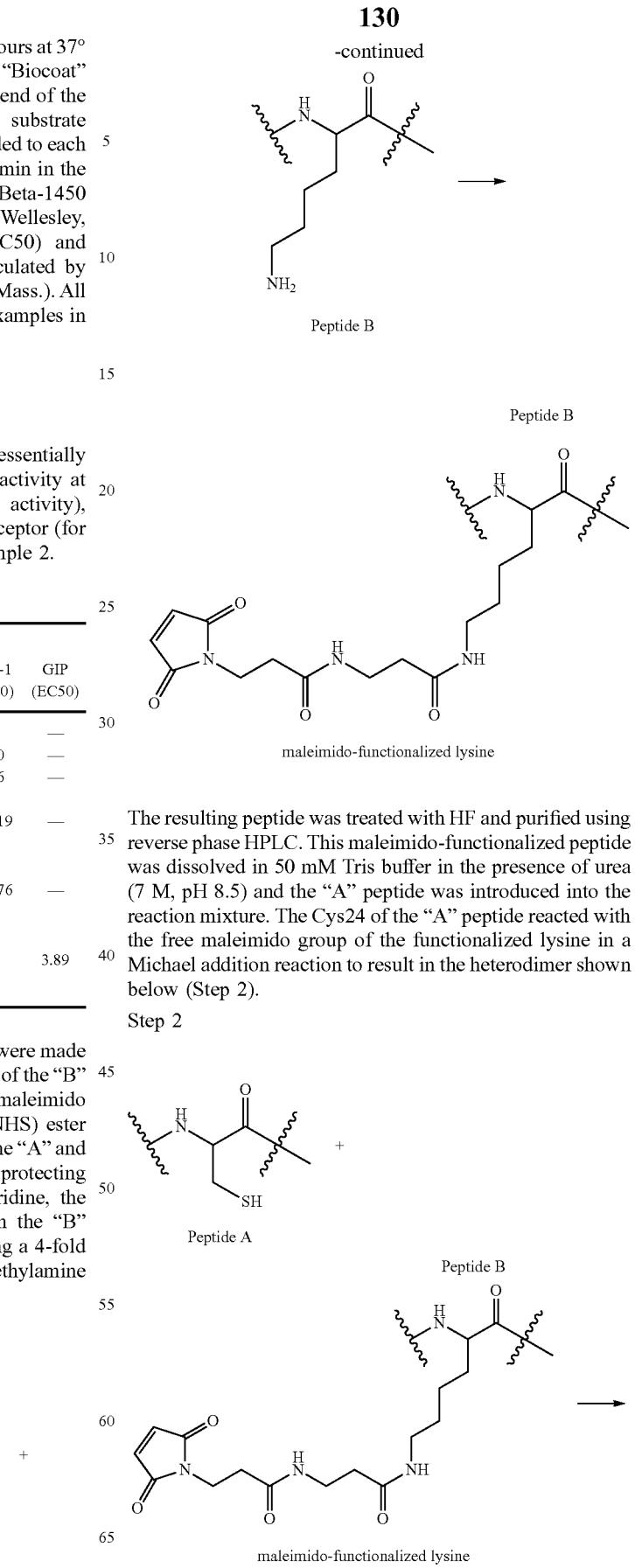

The resulting peptide was treated with HF and purified using reverse phase HPLC. This maleimido-functionalized peptide was dissolved in 50 mM Tris buffer in the presence of urea (7 M, pH 8.5) and the "A" peptide was introduced into the reaction mixture. The Cys24 of the "A" peptide reacted with the free maleimido group of the functionalized lysine in a Michael addition reaction to result in the heterodimer shown below (Step 2).

Step 2

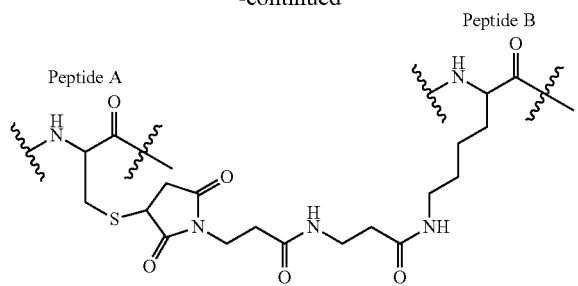

In some embodiments, these heterodimers can be synthesized using a heterobifunctional linker comprising a haloacetyl group instead of a maleimido group. In some embodiments, these heterodimers can be synthesized using a carboxylic acid with a coupling agent known to one skilled in the art (e.g. DIC, TBTU, HATU, DCC, HBTU) instead of an activated carboxylic acid such as the NHS ester.

The resulting heterodimers were tested for in vitro activity at each of the glucagon receptor (for inhibitory activity), GLP-1 activity (for agonist activity), and the GIP receptor (for agonist activity). The data of these in vitro experiments are provided in Table 2.

TABLE 2

| Dimer Name | | Glucagon (EC50) | GLP-1 (EC50) | GIP (EC50) |
|---|---|---|---|---|
| Glucagon (EC50) | | 0.126 | | |
| Native GLP-1 | | | 0.04 | |
| Native GIP | | | | 0.011 |
| A2-B1 | PLA6, (E16K20), C24 G(6-29)/ A1, Aib2, E3, K40 GIP(1-40) | 40.06 | 366.8 | 1.29 |
| A4-B1 | HAibEGT-PLA6, K10(rErEC16), (E16K20), C24 G(1-29)/ A1, Aib2, E3, K40 GIP(1-40) | * | 0.813 | 0.347 |
| A1-B2 | PLA6, E9, C24 G(6-29)/ GIP-GLP(1-40)-K40 | 163.9 | 0.49 | 8.18 |
| A3-B1 | HAibEGT-PLA6, (E16K20), C24 G(1-29)/ A1, Aib2, E3, K40 GIP(1 -40) | * | 11.73 | 1.579 |
| A5-B1 | HAibEGT-PLA6, (E16K20), C24, cex, K40(rErEC16) G(1-40)/ A1, Aib2, E3, K40 GTP(1-40) | * | 0.363 | 0.379 |

Values reported in nM; * Lost antagonist activity.

Example 4

The following peptides were made as essentially described in Example 1 and tested in vitro for agonist activity at each of the GLP-1 receptor, glucagon receptor, and GIP receptor as essentially described in Example 2:

Peptide mt-263 comprised a modified amino acid sequence of SEQ ID NO: 1 in which position 1 was Tyr, position 2 was AIB, position 3 was Glu, position 12 was Ile, positions 16 to 18 were Lys, Gln, Ala, respectively, position 20 was AIB, position 21 was Glu, position 24 was Asn, positions 27-29 were, Leu, Ala, and Gly, respectively, positions 30-40 was GPSSGAPPPSK. The amino acid sequence of Peptide mt-263 is provided herein as SEQ ID NO: 211.

Peptide mt-402 comprised the same amino acid sequence as that of mt-263, except, Gln at position 17 was changed to Lys and Glu at position 3 was changed to Gln. The amino acid sequence of Peptide mt-402 is provided herein as SEQ ID NO: 25.

Peptide mt-403 comprised the same amino acid sequence as that of mt-402, except that the Lys at position 40 was covalently attached via its epsilon amine to a C16 fatty acyl group. The amino acid sequence of mt-403 is provided herein as SEQ ID NO: 26.

Peptide mt-404 comprised the same structure as mt-263, except that the Glu at position 3 was changed to a Gln, the Gln at position 17 was changed to a Lys, and the AIB at position 20 was changed to a Glu. The amino acid sequence of mt-404 is provided herein as SEQ ID NO: 27.

Peptide mt-405 comprised the same amino acid sequence as mt-404, except that the Lys at position 40 was covalently attached via its epsilon amine to a C16 fatty acyl group. The amino acid sequence of mt-405 is provided herein as SEQ ID NO: 28.

The EC50s at the GLP-1 receptor (GLP-1R), the glucagon receptor (GR), and the GIP receptor (GIPR) are provided in Table 3.

TABLE 3

| | GLP-1R | | | GR | | | GIPR | | |
|---|---|---|---|---|---|---|---|---|---|
| Peptide | $EC_{50}$, nM | standard | relative activity | $EC_{50}$, nM | standard | relative activity | $EC_{50}$, nM | standard | relative activity |
| mt-263 | 0.0100 | 0.0154 | 154.20% | 4.0450 | 0.0762 | 1.88% | 0.0054 | 0.0166 | 305.91% |
| mt-402 | 0.0070 | 0.0154 | 220.60% | 0.0298 | 0.0762 | 256.00% | 0.0185 | 0.0166 | 89.46% |
| mt-403 | 0.0027 | 0.0154 | 581.89% | 0.0077 | 0.0762 | 987.18% | 0.0061 | 0.0166 | 273.10% |
| mt-404 | 0.0060 | 0.0154 | 258.29% | 0.1076 | 0.0762 | 70.80% | 0.0327 | 0.0166 | 50.57% |
| mt-405 | 0.0022 | 0.0154 | 717.21% | 0.0096 | 0.0762 | 797.18% | 0.0039 | 0.0166 | 425.45% |

The data suggest that acylation dramatically enhances activity at each of the three receptors.

Example 5

Peptides mt-395 (SEQ ID NO: 33), mt-396 (SEQ ID NO: 34), mt-397 (SEQ ID NO: 35), and mt-398 (SEQ ID NO: 36) which were based on the structure of mt-263 were made as essentially described in Example 1 and tested in vitro as essentially described in Example 2. These peptides comprised the same structure as mt-263 except for the Lys at position 40 of mt-263 was changed to Glu in mt-396, Arg in mt-397, d-Lys in mt-398, or deleted altogether in mt-395. The EC50s at each of the GLP-1R, GR, and GIPR are shown in Table 4.

TABLE 4

| Peptide | GLP-1R | | | GR | | | GIPR | | |
| --- | --- | --- | --- | --- | --- | --- | --- | --- | --- |
| | $EC_{50}$, nM | standard | relative activity | $EC_{50}$, nM | standard | relative activity | $EC_{50}$, nM | standard | relative activity |
| mt-263 | 0.0081 | 0.0245 | 300.61% | 3.1371 | 0.0298 | 0.95% | 0.0033 | 0.0135 | 403.89% |
| mt-395 | 0.0076 | 0.0245 | 321.55% | 3.4095 | 0.0298 | 0.87% | 0.0025 | 0.0135 | 537.45% |
| mt-396 | 0.0093 | 0.0245 | 262.27% | 2.9033 | 0.0298 | 1.03% | 0.0034 | 0.0135 | 402.69% |
| mt-397 | 0.0085 | 0.0245 | 287.88% | 5.3528 | 0.0298 | 0.56% | 0.0029 | 0.0135 | 470.03% |
| mt-398 | 0.0078 | 0.0245 | 314.93% | 3.7352 | 0.0298 | 0.80% | 0.0031 | 0.0135 | 433.76% |

These data suggest that Lys at position 40 can be a negative charged or positive charged amino acid or can be deleted altogether and still exhibit potent activity at the GLP-1R and GIPR.

Example 6

The following peptides were made as essentially described in Example 1 and tested for agonist activity at each of the GLP-1R, GR, and GIPR as essentially described in Example 2.

Each of peptides mt-217 (SEQ ID NO: 19), mt-218 (SEQ ID NO: 20), mt-219 (SEQ ID NO: 21), and mt-220 (SEQ ID NO: 22 comprised a modified amino acid sequence of SEQ ID NO: 1 in which the following substitutions were made: Tyr at position 1, AIB at position 2, Ile at position 12, Glu at position 16, Gln at position 17, Ala at position 18, Lys at position 20, Glu at position 21, Lys at position 24, Phe at position 25, Leu-Ala-Gly at positions 27-29, and GPSS-GAPPPS (SEQ ID NO: 3) at positions 30-39. The amino acids at positions 16 and 20 were bridged by a lactam. The Lys at position 24 of each of these peptides were attached to an amino acid spacer, which in turn, was attached to an acetylated Cys, which, in turn, was attached to a 40 kDa PEG. Peptide mt-217 had Ala as the amino acid spacer, mt-218 had Glu as the amino acid spacer, mt-219 had Arg as the amino acid spacer, and mt-220 had Phe as the amino acid spacer.

Peptides mt-225 (SEQ ID NO: 359), mt-226 (SEQ ID NO: 23), mt-227 (SEQ ID NO: 360), and mt-228 (SEQ ID NO: 24) comprised the same amino acid sequences as mt-217, mt-218, mt-219, and mt-220, respectively, except that the modified Lys residue was at position 40 and the amino acid at position 24 was changed to Asn.

The in vitro EC50s at each of the three receptors are shown in Table 5.

TABLE 5

| Code | GLP-1R | | | GR | | | GIPR | | |
| --- | --- | --- | --- | --- | --- | --- | --- | --- | --- |
| | $EC_{50}$, nM | standard | relative activity | $EC_{50}$, nM | standard | relative activity | $EC_{50}$, nM | Standard | relative activity |
| mt-217 | 0.222 | 0.025 | 11.26% | 13.886 | 0.114 | 0.82% | 9.574 | 0.019 | 0.20% |
| mt-218 | 0.338 | 0.025 | 7.40% | 16.298 | 0.114 | 0.70% | 14.283 | 0.019 | 0.13% |
| mt-219 | 0.151 | 0.025 | 16.56% | 17.628 | 0.114 | 0.65% | 6.165 | 0.019 | .31% |
| mt-220 | 0.180 | 0.025 | 13.89% | 9.670 | 0.114 | 1.18% | 10.268 | 0.019 | 0.19% |

TABLE 5-continued

| | GLP-1R | | | GR | | | GIPR | | |
|---|---|---|---|---|---|---|---|---|---|
| Code | EC$_{50}$, nM | standard | relative activity | EC$_{50}$, nM | standard | relative activity | EC$_{50}$, nM | Standard | relative activity |
| mt-225 | 0.098 | 0.029 | 29.59% | 2.712 | 0.054 | 1.99% | 1.899 | 0.017 | 0.90% |
| mt-226 | 0.097 | 0.029 | 29.90% | 3.462 | 0.054 | 1.56% | 1.467 | 0.017 | 1.16% |
| int-227 | 0.080 | 0.029 | 36.25% | 4.244 | 0.054 | 1.27% | 1.320 | 0.017 | 1.29% |
| mt-228 | 0.146 | 0.029 | 19.86% | 5.364 | 0.054 | 1.01% | 2.266 | 0.017 | 0.75% |

Example 7

Different doses of acylated peptides comprising an AIB at position 2, Glu at position 3, a Lys at position 16, and an AIB at position 20 were tested in vivo. The peptides were acylated at position 10 or position 40 of the peptide, in the presence or absence of an acylation spacer. More specifically, peptides mt-261, mt-367, mt-270, and mt-369 at 1 or 10 nmol/kg were subcutaneously injected daily for one week into mice (C57Bl/6) aged 6 months old and having an initial body weight of 45 g. The mice had been on a diabetogenic diet for 4 months. Body weight, food intake, blood glucose levels, and fat mass were measured during the experiment. Each test group and control group consisted of 8 mice. Table 6 provides the shorthand notation of each peptide indicating some of the amino acid modifications in the sequence, the SEQ ID NO: of the amino acid sequence of each peptide and the % relative activity at each of the GLP-1R, GR, and GIPR as determined by the in vitro assay essentially described in Example 2.

TABLE 6

| Peptide | SEQ ID NO: | Peptide Name | Acyl Spacer | Position of Acyl | % Relative Activity | | |
|---|---|---|---|---|---|---|---|
| | | | | | GLP-1R | at GR | at GIPR |
| MT-261 | 205 | E3K16AIB2,20K40(C16) | − | 40 | 299 | 32 | 298 |
| MT-367 | 335 | E3K16AIB2,20K40(rErE-C16) | + | 40 | 406 | 4 | 203 |
| MT-270 | 218 | E3K16AIB2,20K10(C16) | − | 10 | 212 | 0.1 | 163 |
| MT-369 | 337 | E3K16AIB2,20K10(rErE-C16) | + | 10 | 385 | 2 | 204 |

% relative activity is the activity of the indicated peptide relative to the activity of the native ligand at the indicated receptor.

As shown in FIG. 1, mice that were injected with 10 nmol/kg peptide exhibited a total change in body weight (%) (as calculated by subtracting the body weight on Day 0 from the body weight on Day 7) of at least −10%. A dramatic effect was observed with peptide MT-369. The presence of an acylation spacer had a bigger impact on the outcome (change in body weight) when the peptide was acylated at position 10, as compared to when the peptide was acylated at position 40.

Figure 2:
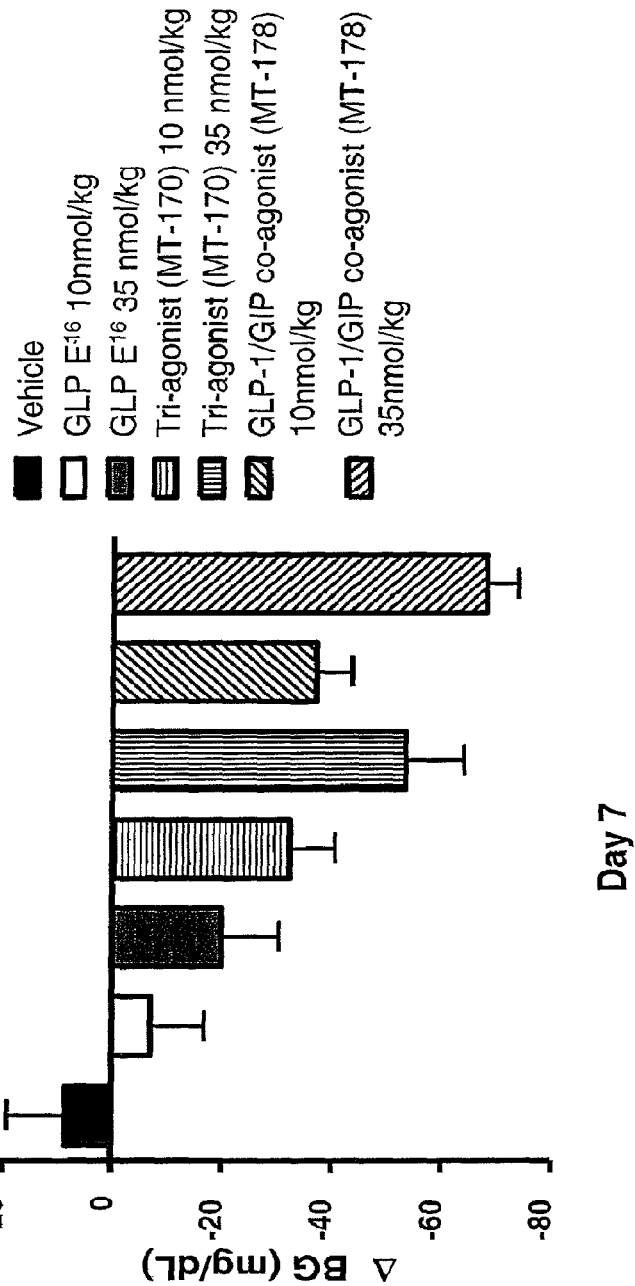
FIG. 2 is a graph of the change in blood glucose levels (mg/dL) in mice at Day 7 after administration of vehicle alone (black bar), GLP-1 E 16 agonist at 10 nmol/kg (white bar) or 35 nmol/kg (grey bar), triagonist peptide MT-170 at 10 nmol/kg (horizontal lined bar) or 35 nmol/kg (vertical lined bar), or GLP-1/GIP co-agonist peptide MT-178 at 10 nmol/kg (right-left diagonal lined bar) or at 35 nmol/kg (left-right diagonal lined bar).

As shown in FIG. 2, mice that were injected with 10 nmol/kg peptide demonstrated a total change in blood glucose levels (as calculated by subtracting the blood glucose levels on Day 0 from that on Day 7) of at least −40 mg/dL. The peptide which was acylated at position 10 with an acylation spacer decreased the blood glucose levels almost 100 mg/dL.

Example 8

Different doses of acylated peptides comprising a Lys at position 16 and an AIB at position 20 were tested in vivo. Specifically, peptides MT-367, MT-369, MT-368, MT-384, MT-385, and MT-364 at 10 nmol/kg were subcutaneously injected daily for one week into DIO mice (C57Bl/6 WT) aged ~10 months old and having an initial body weight of 57.6 g. The mice had been on a high fat diet diet for ~8 months. Body weight and food intake were measured on days 0, 1, 3, 5, and 7, whereas blood glucose levels were measured on Days 0 and 7 of the experiment. Each test group and control group consisted of 8 mice. Table 7 provides the shorthand notation of each peptide indicating some of the amino acid modifications in the sequence, the SEQ ID NO: of the amino acid sequence of each peptide and the % relative activity at each of the GLP-1R, GR, and GIPR as determined by the in vitro assay essentially described in Example 2.

TABLE 7

| Peptide | SEQ ID NO: | Peptide Name | Acyl Spacer | Position of Acyl | % Relative Activity | | |
|---|---|---|---|---|---|---|---|
| | | | | | GLP-1R | at GR | at GIPR |
| MT-367 | 335 | E3K16AIB20K40(rErE-C16) | + | 40 | 406 | 4 | 203 |
| MT-369 | 336 | E3K16AIB20K10(rErE-C16) | + | 10 | 385 | 2 | 204 |
| MT-368 | 337 | Q3K16AIB20K40(rErE-C16) | + | 40 | 419 | 492 | 296 |

TABLE 7-continued

| Peptide | SEQ ID NO: | Peptide Name | Acyl Spacer | Position of Acyl | % Relative Activity GLP-1R | at GR | at GIPR |
|---|---|---|---|---|---|---|---|
| MT-384 | 29 | Q3K16AIB20K10(rErE-C16) | + | 10 | 349 | 228 | 808 |
| MT-385 | 31 | Q3I7K16AIB20K10(rErE-C16) | + | 10 | 3 | 239 | 715 |
| MT-364 | 1069 | Chimera2-CEXK40(C16) | − | 40 | 355 | 350 | 16 |

% Relative Activity is activity of the peptide at the indicated receptor relative to the native ligand of that receptor.

Figure 3:
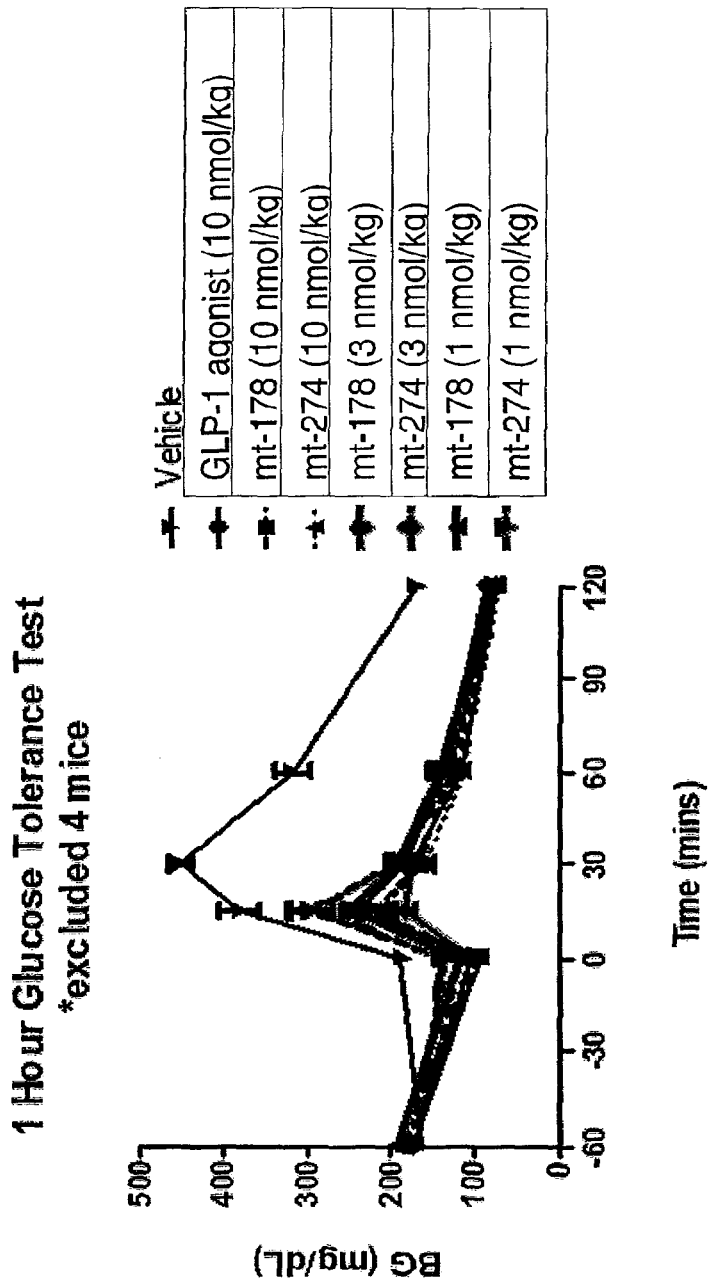
FIG. 3 represents a graph of the blood glucose levels (mg/dL) as a function of time before and after a glucose injection (administered at timepoint 0) of mice injected (at timepoint −60) with a vehicle control, a GLP-1 agonist peptide control, a lactam-containing (cyclic), pegylated, GIP-active glucagon analog ("mt-178"), or a lactam-lacking (linear), pegylated, GIP-active glucagon analog ("mt-274") at 1, 3, or 10 nmol/kg/week. The data of this figure excludes the data of four mice, as these mice exhibited aggressive behavior and substantial weight loss.

As shown in FIG. 3, mice injected with a peptide which exhibited in vitro activity at the GLP-1 receptor demonstrated a total change in body weight (%) of at least 18%, whereas the group of mice that were injected with MT-385 (comprising an Ile at position 7, which decreases GLP-1 R activity) exhibited a lower change in body weight, thereby demonstrating the importance of the GLP-1 agonist aspect of the peptide.

Figure 4:
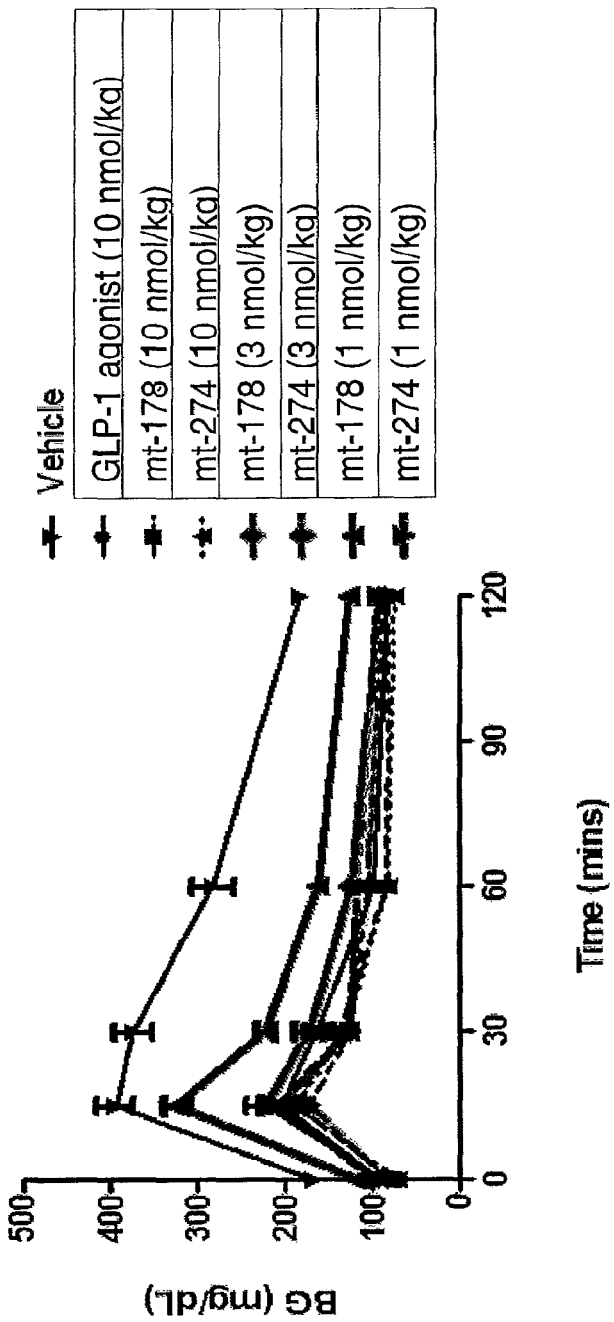
FIG. 4 represents a graph of the blood glucose levels (mg/dL) as a function of time before and after a glucose injection (administered at timepoint 0) of mice injected (24 hours before the glucose injection) with a vehicle control, a GLP-1 agonist peptide control, mt-178, or mt-274 at 1, 3, or 10 nmol/kg/week. The data of this figure excludes the data of four mice, as these mice exhibited aggressive behavior and substantial weight loss.

As shown in FIG. 4, mice injected with MT-385, MT-364, MT-384 or MT-369 exhibited a total change in blood glucose levels of greater than −50 mg/dL.

Example 9

Peptides comprising a Glu or Gln at position 3, Lys at position 16, Gln at position 17, Ala at position 18, and an AIB at positions 2 and 20, along with a Glu at position 21, Asn at position 24, and a C-terminal extension of GPSS-GAPPPSK (SEQ ID NO: 1334) were made and tested in vivo as essentially described in the previous Examples.

More specifically, peptides having the amino acid sequences of the SEQ ID NOs: indicated in Table 8 were made. None of the peptides comprised an acyl group. C57Bl/6 mice with an initial body weight of 55 g were subcutaneously injected daily with 30 nmol/kg for one week. The mice were 10 months old and had been on a diabetogenic diet for 8 months. Body weight, food intake, blood glucose levels and fat mass were monitored during the course of the study.

Table 8 provides the shorthand notation of each peptide indicating some of the amino acid modifications in the sequence, the SEQ ID NO: of the amino acid sequence of each peptide and the % relative activity at each of the GLP-1R, GR, and GIPR as determined by the in vitro assay essentially described in Example 2.

Figure 5:
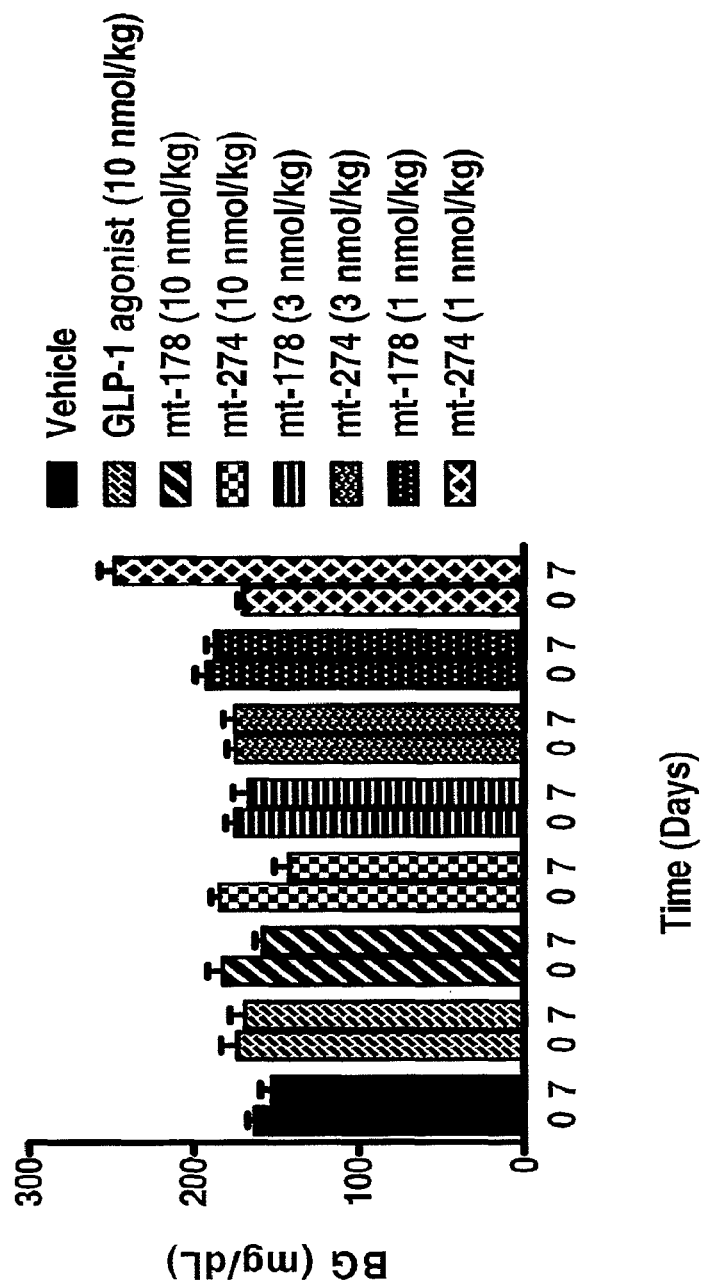
FIG. 5 represents a graph of the blood glucose levels (mg/dL) of mice 0 or 7 days after injection with a vehicle control, a GLP-1 agonist peptide control, mt-178, or mt-274 at 1, 3, or 10 nmol/kg/week. The data of this figure excludes the data of four mice, as these mice exhibited aggressive behavior and substantial weight loss.

As shown in FIG. 5, mice injected with MT-263 comprising a Glu at position 3 demonstrated a significant weight loss over the course of the 7-day study. This peptide achieved levels of weight loss substantially greater than the Exendin-4-like positive control peptide.

Figure 6:
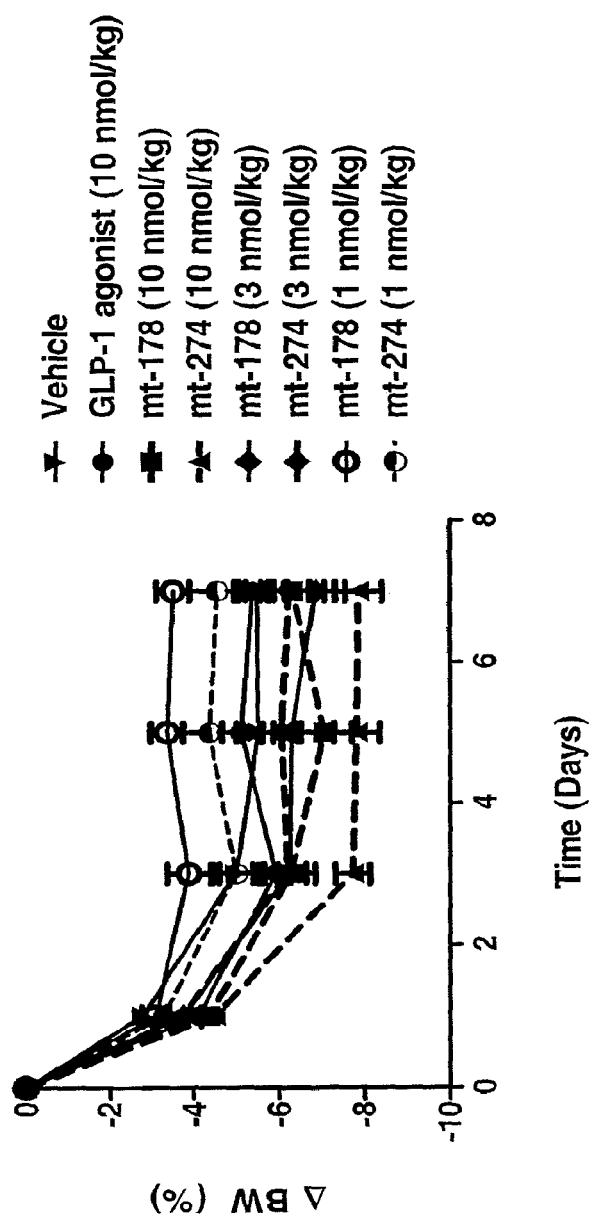
FIG. 6 represents a graph of the percent change in body weight of mice 0, 1, 3, 5, and 7 days after injection with a vehicle control, a GLP-1 agonist peptide control, mt-178, or mt-274 at 1, 3, or 10 nmol/kg/week. The data of this figure excludes the data of four mice, as these mice exhibited aggressive behavior and substantial weight loss.

As shown in FIG. 6, MT-263 achieved the greatest change in blood glucose levels over the course of the 7-day study. Mice injected with MT-280 also demonstrated a significant decrease in blood glucose levels.

Example 10

The pharmokinetic properties of Peptide MT-263 were tested by varying the administration regimen. Diet-induced obesity (DIO) mice (N=8, 10 mice per group) were injected during the course of the 6 day study as follows:
Groups A and B: daily injections of 10 nmol/kg MT-263 in vehicle;
Group C: injections every other day with 20 nmol/kg MT-263 in vehicle;
Groups D and E: injections every 3 days with 30 nmol/kg of MT-263 in vehicle.

Figure 7:
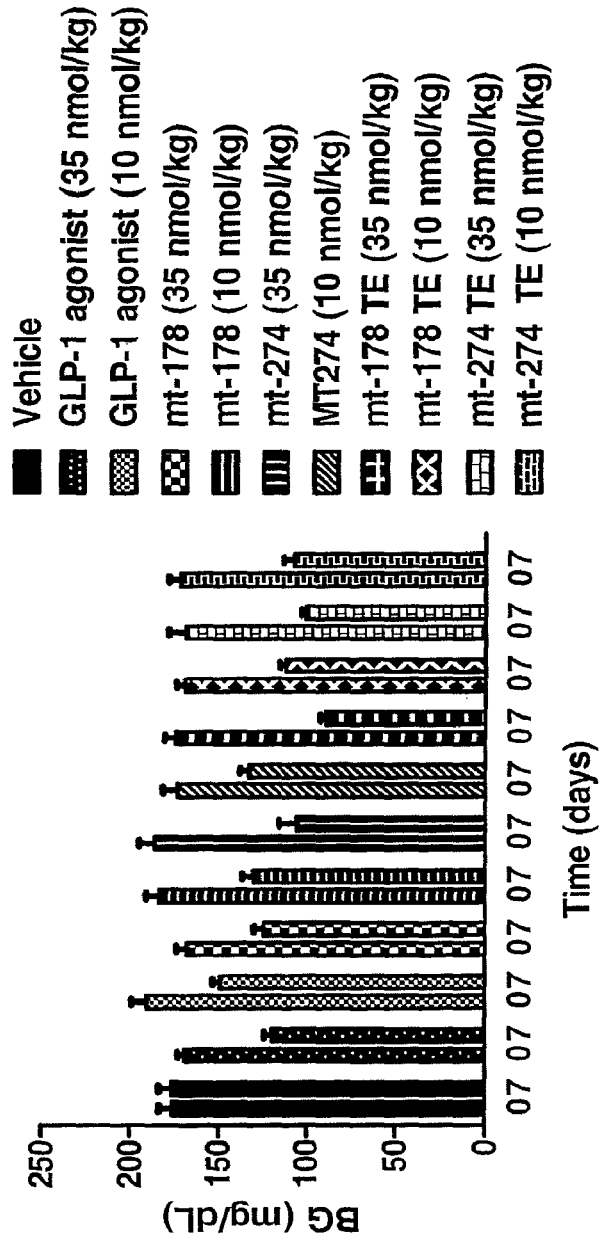
FIG. 7 represents a graph of the blood glucose levels (mg/dL) of mice 0 or 7 days after injection with a vehicle control, a GLP-1 agonist peptide control, mt-178, mt-178 (TE), mt-274, or mt-274(TE) at 10 or 35 nmol/kg/week. "TE" indicates a PEG group attached to the Cys at position 40.

As shown in FIG. 7, the % change in body weight of mice injected with peptide on a daily basis exhibited a steady weight loss over the course of the six day study.

Figure 8:
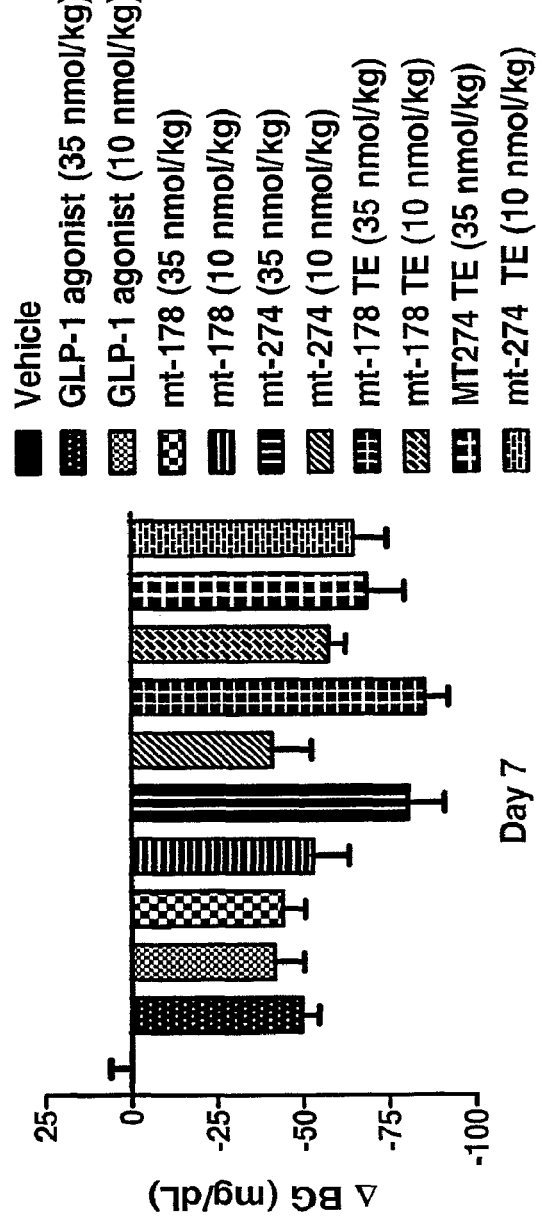
FIG. 8 represents a graph of the change in blood glucose (mg/dL) of mice 7 days after injection with a vehicle control, a GLP-1 agonist peptide control, mt-178, mt-178(TE), mt-274, or mt-274(TE) at 10 or 35 nmol/kg/week. "TE" indicates a PEG group attached to the Cys at position 40.
Figure 9:
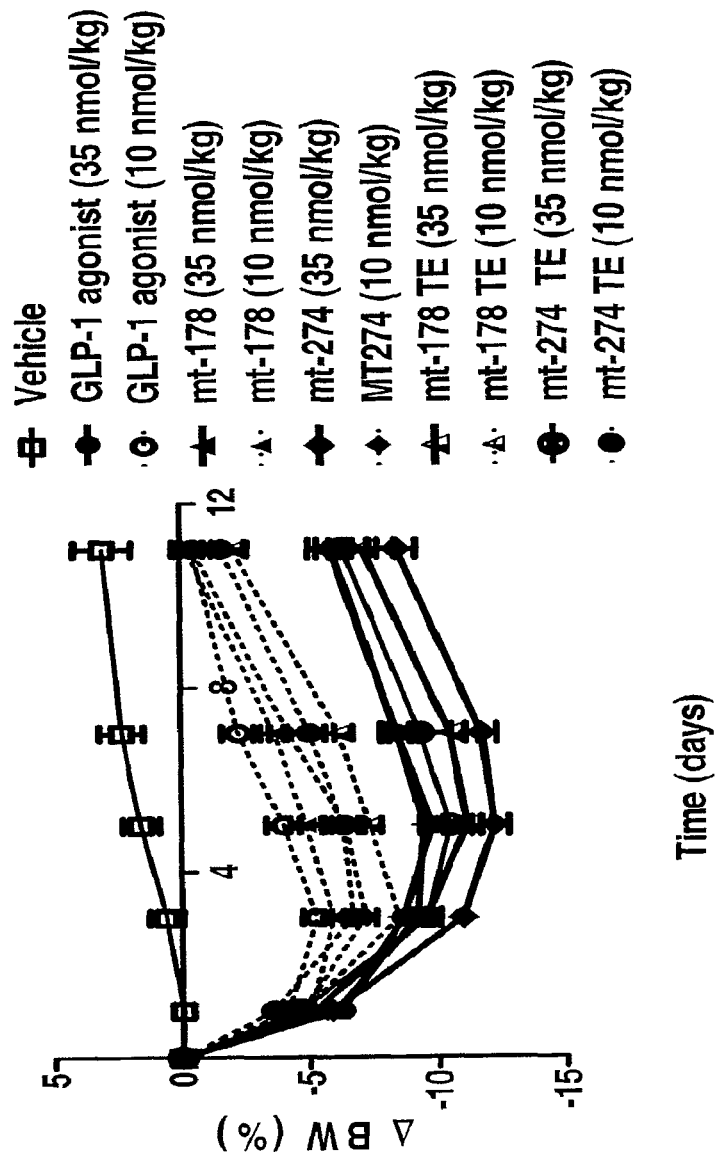
FIG. 9 represents a graph of the percent change in body weight of mice 0, 1, 3, 5, 7, and 10 days after injection with a vehicle control, a GLP-1 agonist peptide control, mt-178, mt-178(TE), mt-274, or mt-274(TE) at 10 or 35 nmol/kg/week. "TE" indicates a PEG group attached to the Cys at position 40.
Figure 10:
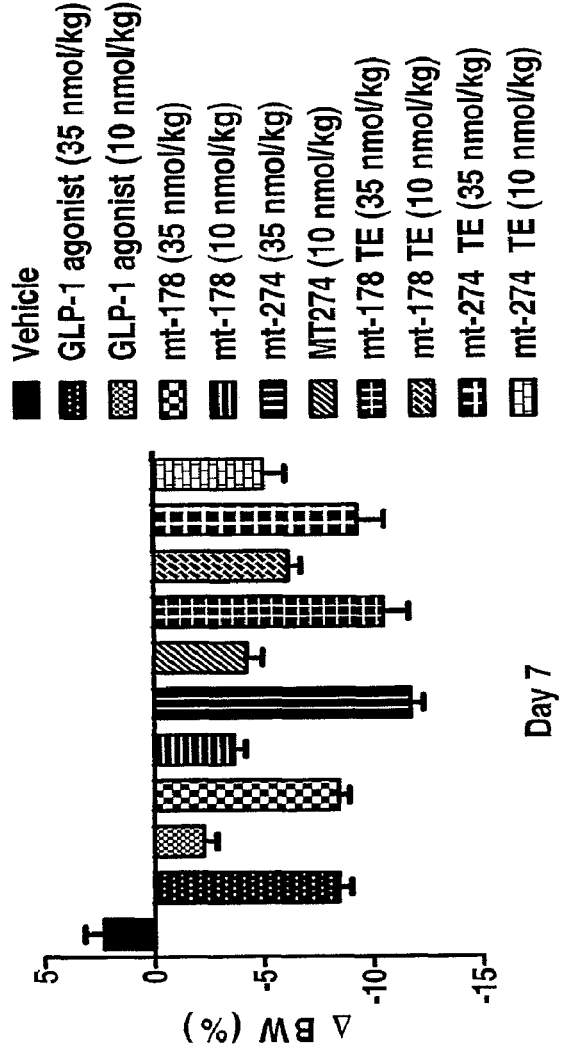
FIG. 10 represents a graph of the percent change in body weight of mice 7 days after injection with a vehicle control, a GLP-1 agonist peptide control, mt-178, mt-178(TE), mt-274, or mt-274(TE) at 10 or 35 nmol/kg/week. "TE" indicates a PEG group attached to the Cys at position 40.
Figure 11:
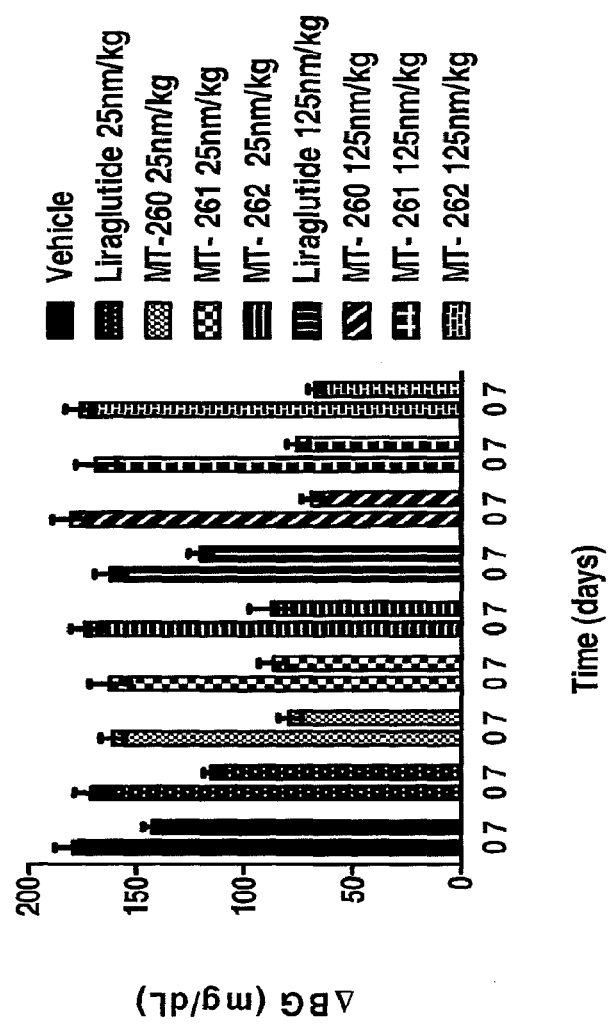
FIG. 11 represents a graph of the change in blood glucose levels (mg/dL) of mice 0 and 7 days after QD injections for 7 days with a vehicle control, liraglutide (an acylated GLP-1 analog), a C14 fatty acylated, unpegylated linear peptide ("mt-260"), a C16 fatty acylated, unpegylated linear peptide ("mt-261"), or a C18 fatty acylated, unpegylated linear peptide ("mt-262") at 25 or 125 nmol/kg.
Figure 12:
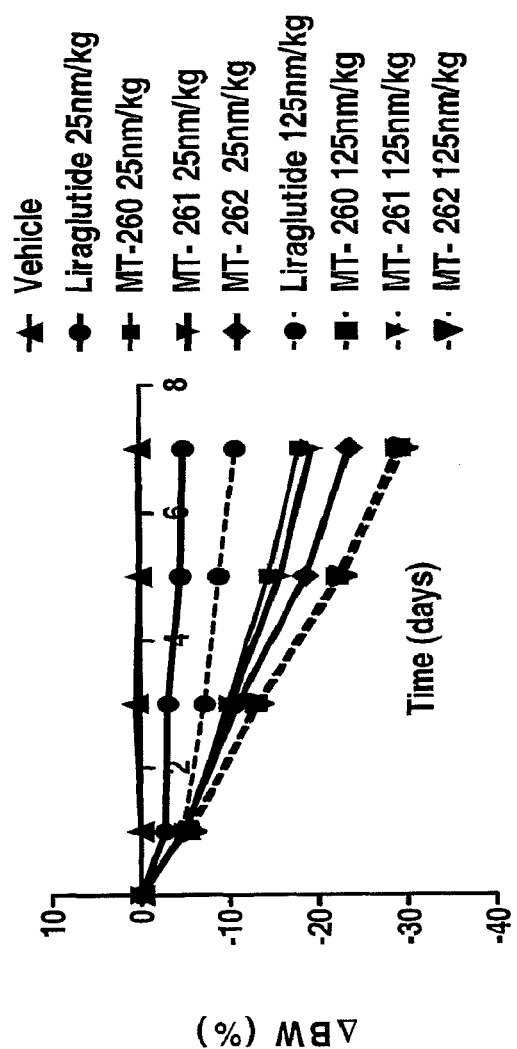
FIG. 12 represents a graph of the percent change in body weight of mice 0, 1, 3, 5, and 7 days after injection with a vehicle control, liraglutide, mt-260, mt-261, or mt-262 at 25 or 125 nmol/kg.
Figure 13:
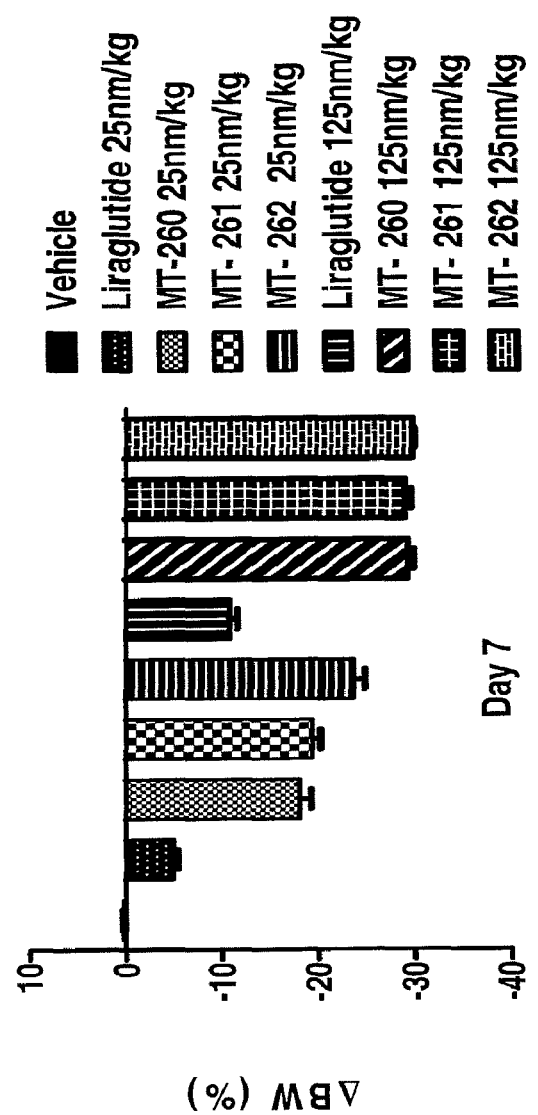
FIG. 13 represents a graph of the percent change in body weight of mice 7 days after injection with a vehicle control, liraglutide, mt-260, mt-261, or mt-262 at 25 or 125 nmol/kg.
Figure 14:
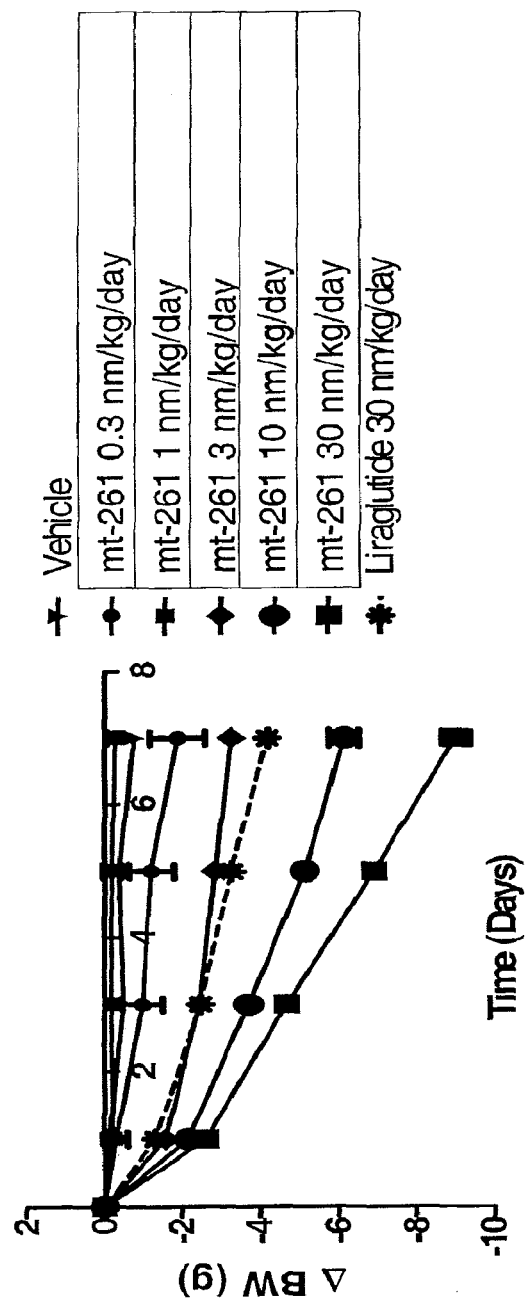
FIG. 14 represents a graph of the change in body weight (g) of mice 0, 1, 3, 5, and 7 days after the first injection with a vehicle control, liraglutide (30 nmol/kg/day), or mt-261 (0.3, 1, 3, 10, or 30 nmol/kg/day).
Figure 15:
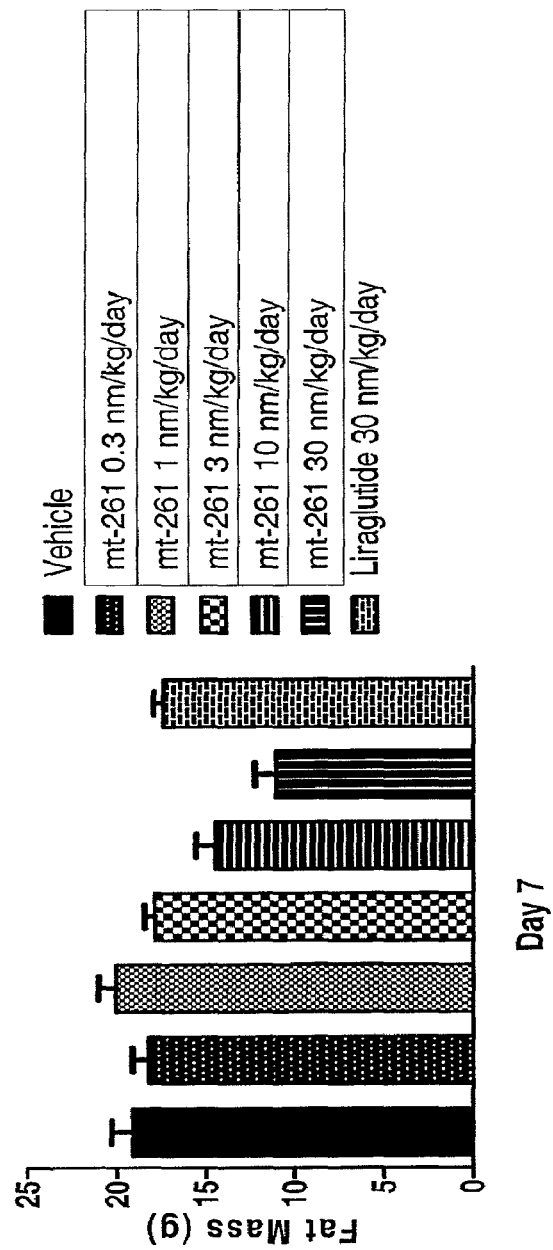
FIG. 15 represents a graph of the fat mass of mice 7 days after the first injection with a vehicle control, liraglutide (30 nmol/kg/day), or mt-261 (0.3, 1, 3, 10, or 30 nmol/kg/day).
Figure 16:
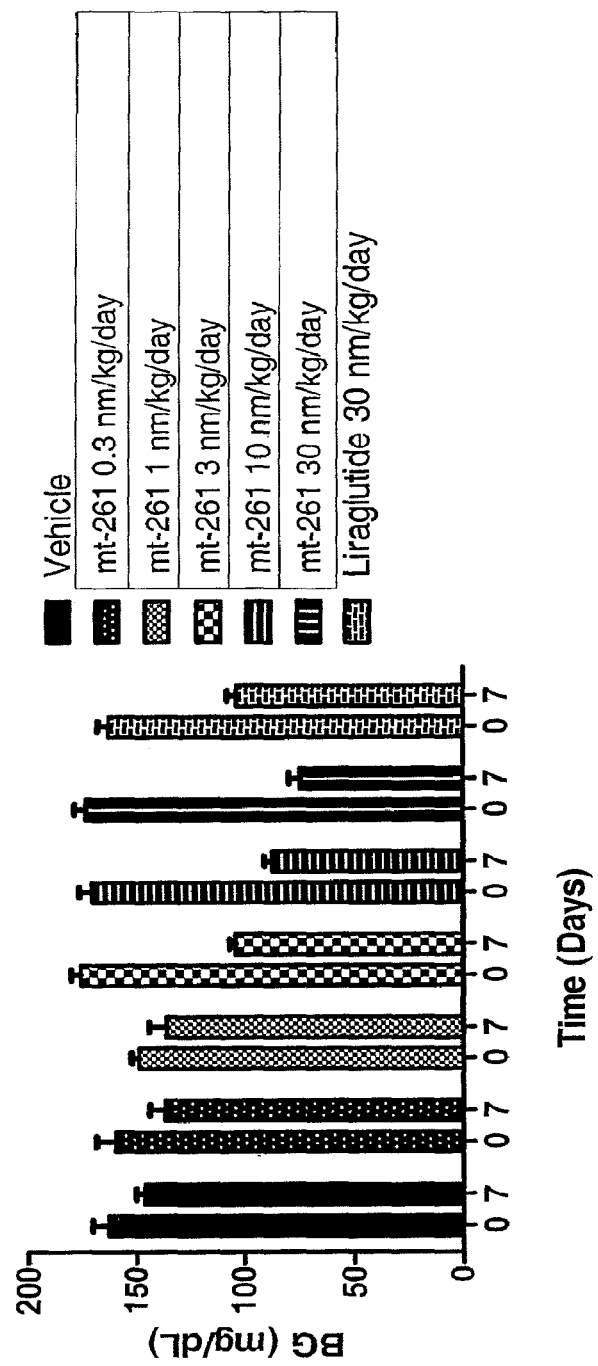
FIG. 16 represents a graph of the blood glucose levels (mg/dL) of mice 0 and 7 days after the first injection with a vehicle control, liraglutide (30 nmol/kg/day), or mt-261 (0.3, 1, 3, 10, or 30 nmol/kg/day).
Figure 17:
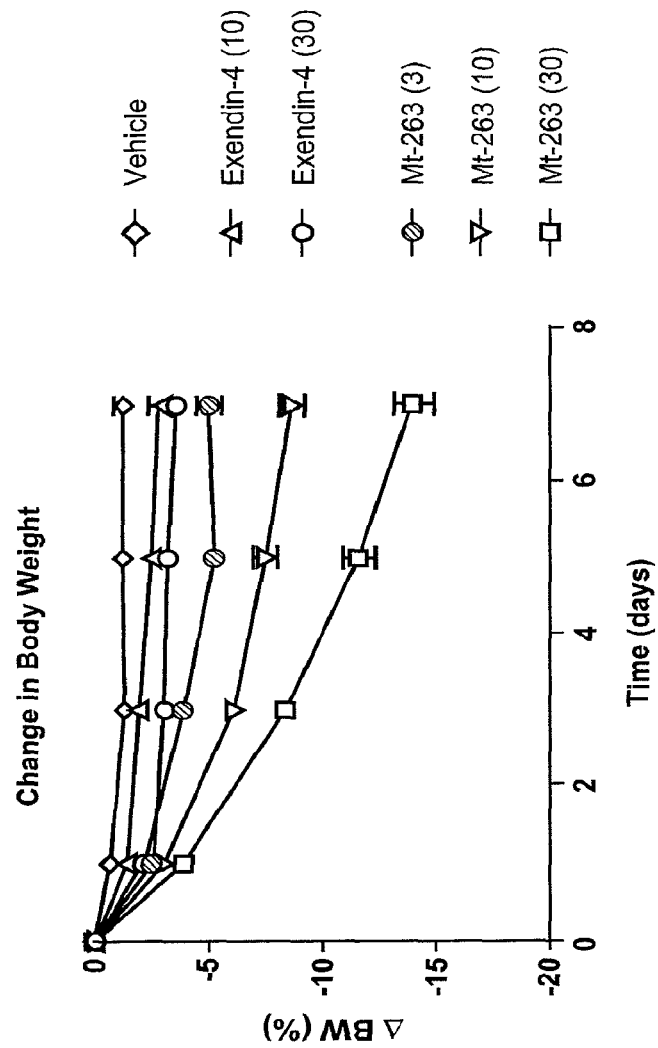
FIG. 17 represents a line graph of the change in body weight (% change) as a function of time of mice injected with mt-263, Exendin-4, or a vehicle control at the doses (nmol/kg/day) indicated in ( ).
Figure 18:
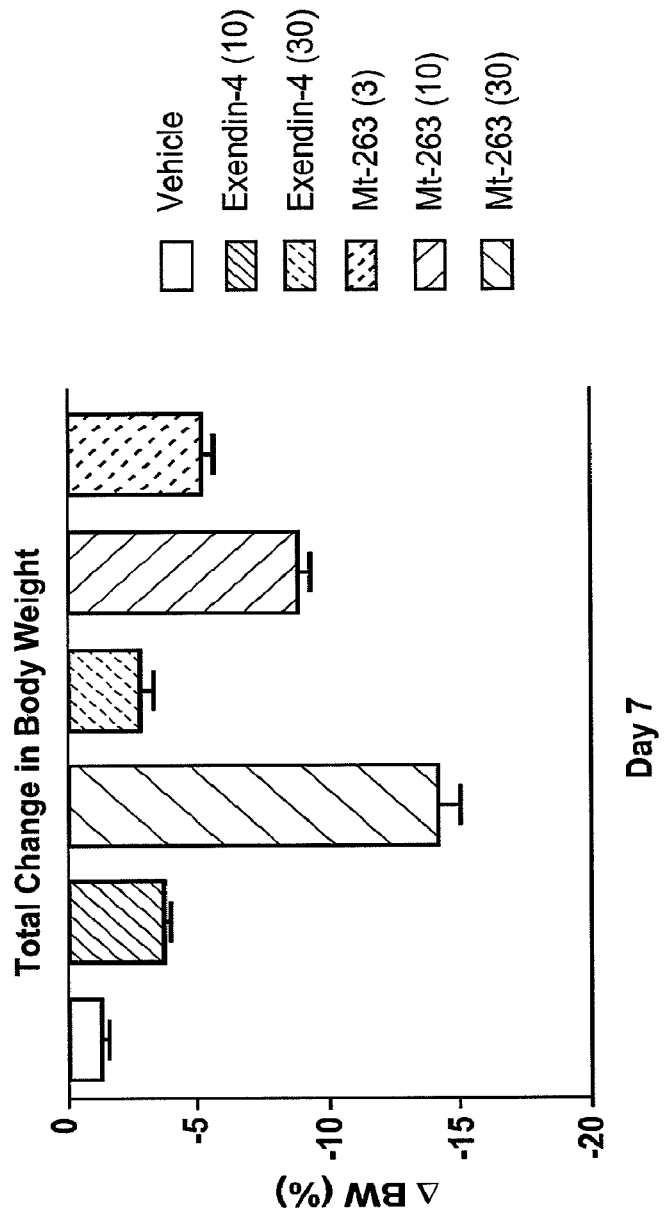
FIG. 18 represents a bar graph of the total change in body weight (%) (as measured on Day 7 in comparison to Day 0) of mice injected with mt-263, Exendin-4, or a vehicle control at the doses (nmol/kg/day) indicated in ( ).
Figure 19:
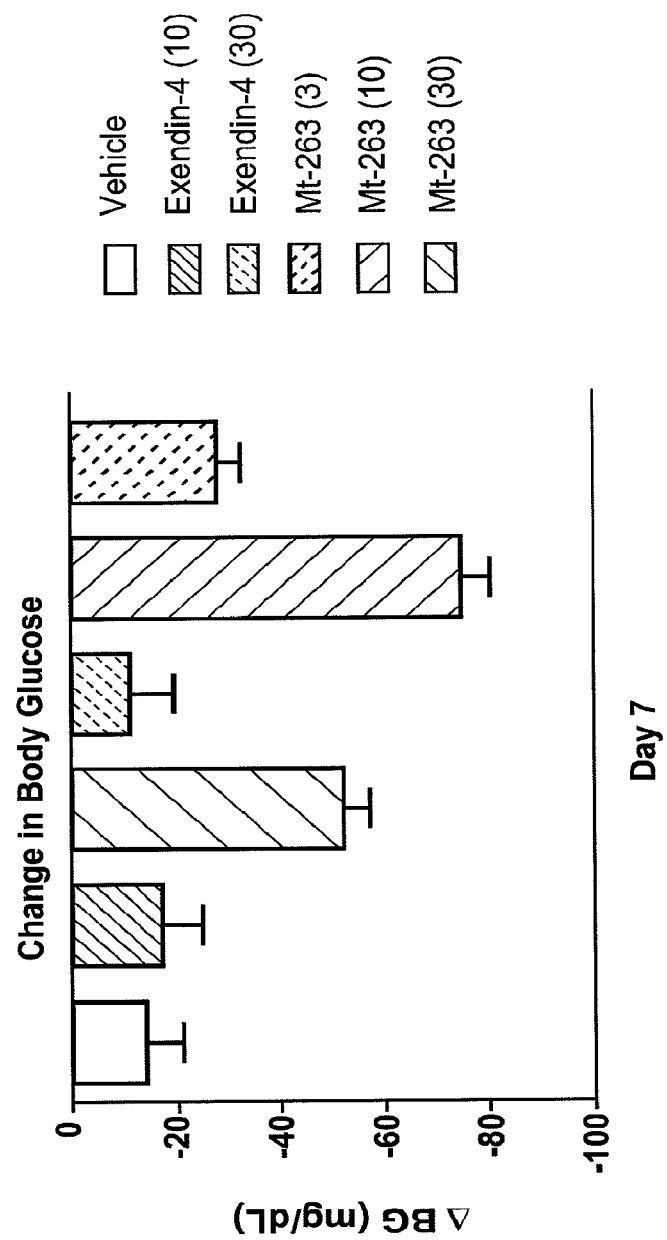
FIG. 19 represents a bar graph of the change in blood glucose levels (mg/dL) (as measured on Day 7 in comparison to Day 0) of mice injected with mt-263, Exendin-4, or a vehicle control at the doses (nmol/kg/day) indicated in ( ).
Figure 20:
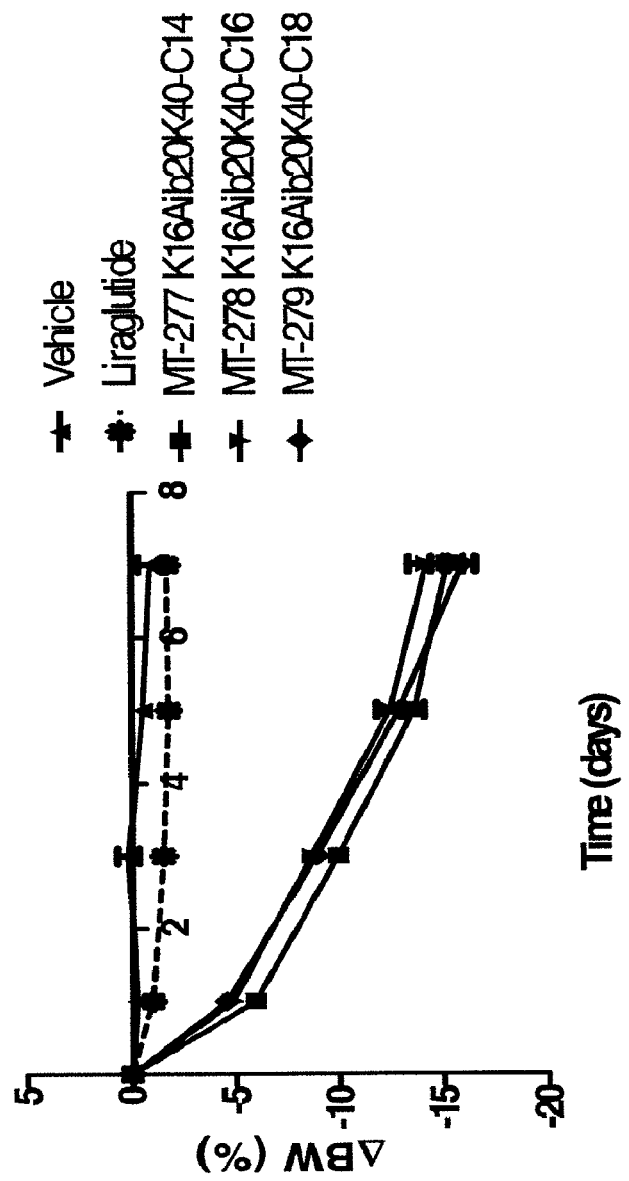
FIG. 20 represents a graph of the % change in body weight of mice 0, 1, 3, 5, and 7 days after the first injection with a vehicle control, liraglutide, mt-277, mt-278, or mt-279.
Figure 21:
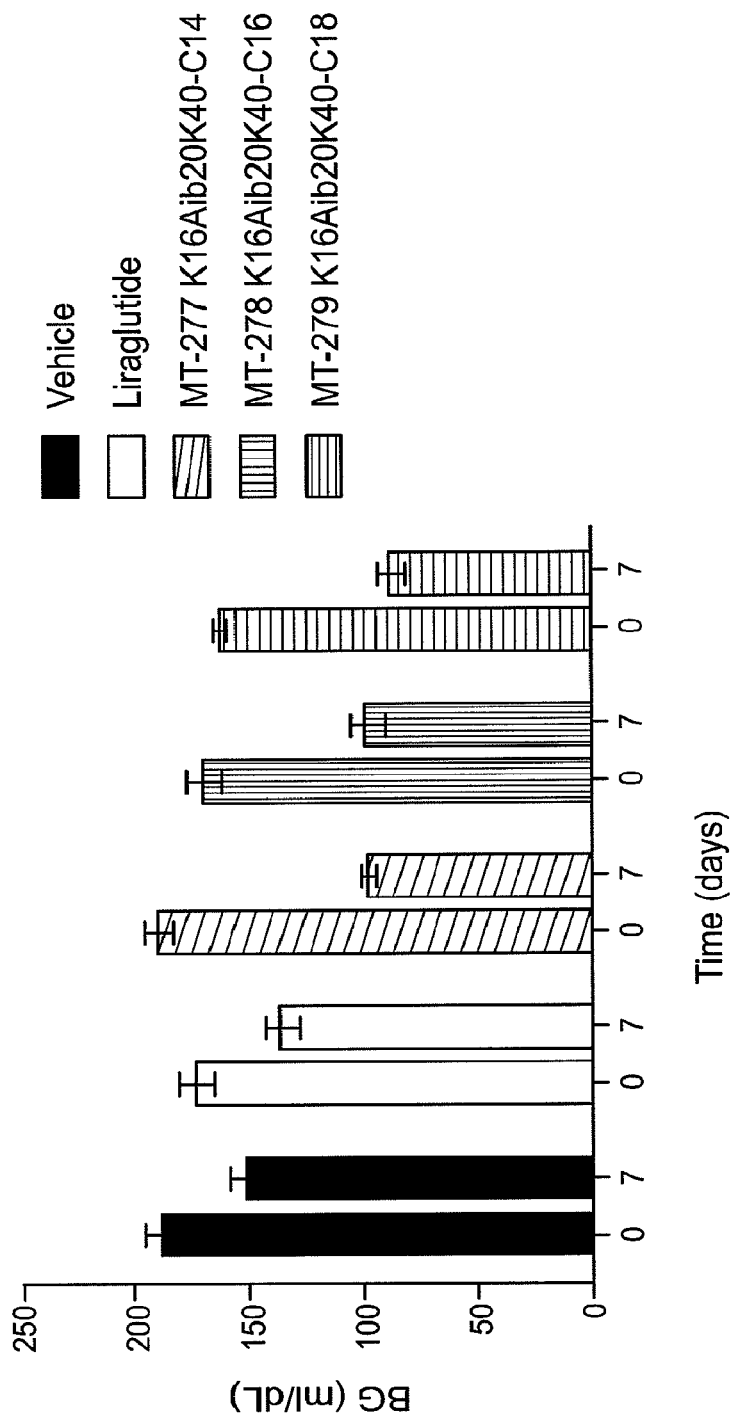
FIG. 21 represents a graph of the blood glucose levels (mg/dL) of mice 0 and 7 days after the first injection with a vehicle control, liraglutide, mt-277, mt-278, or mt-279.
Figure 22:
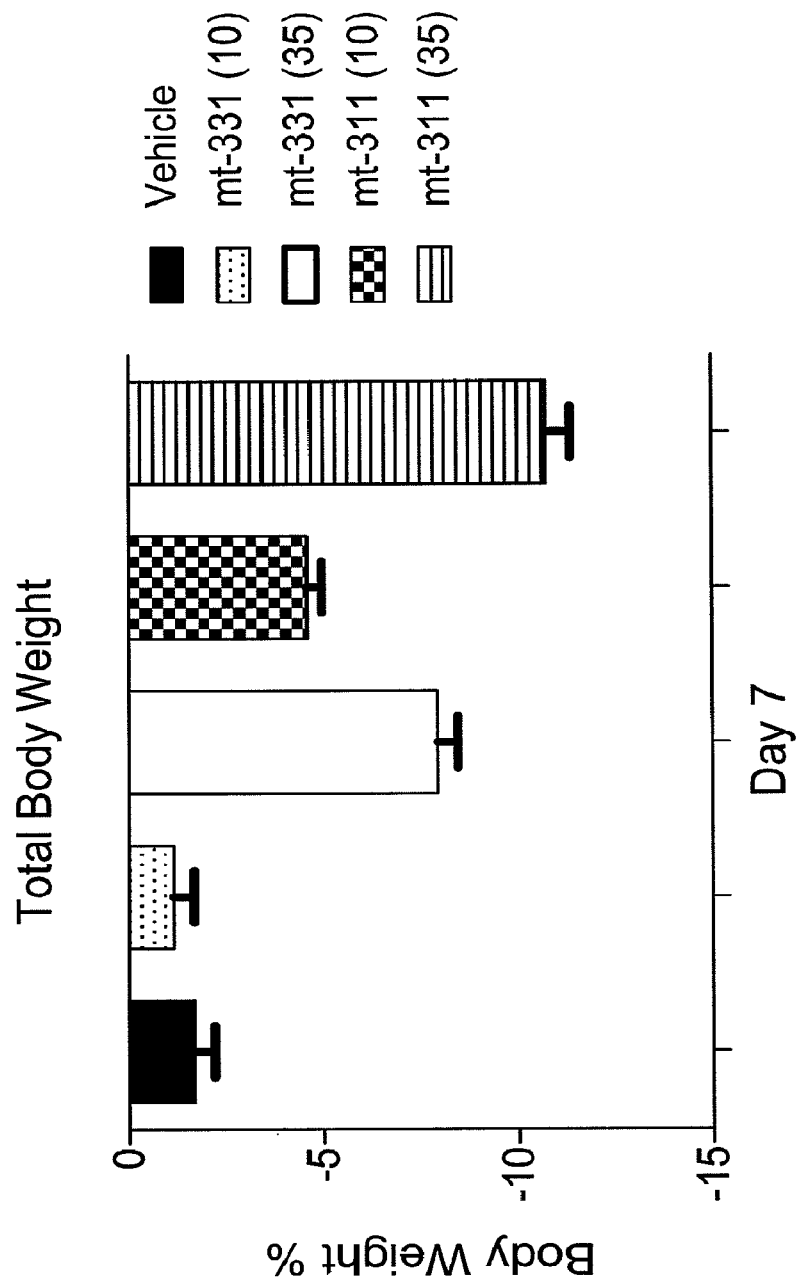
FIG. 22 represents a graph of the total change in body weight (%) of mice as measured 7 days after administration of mt-331, mt-311, or a vehicle control. Doses (nmol/kg) are indicated in ( ).
Figure 23:
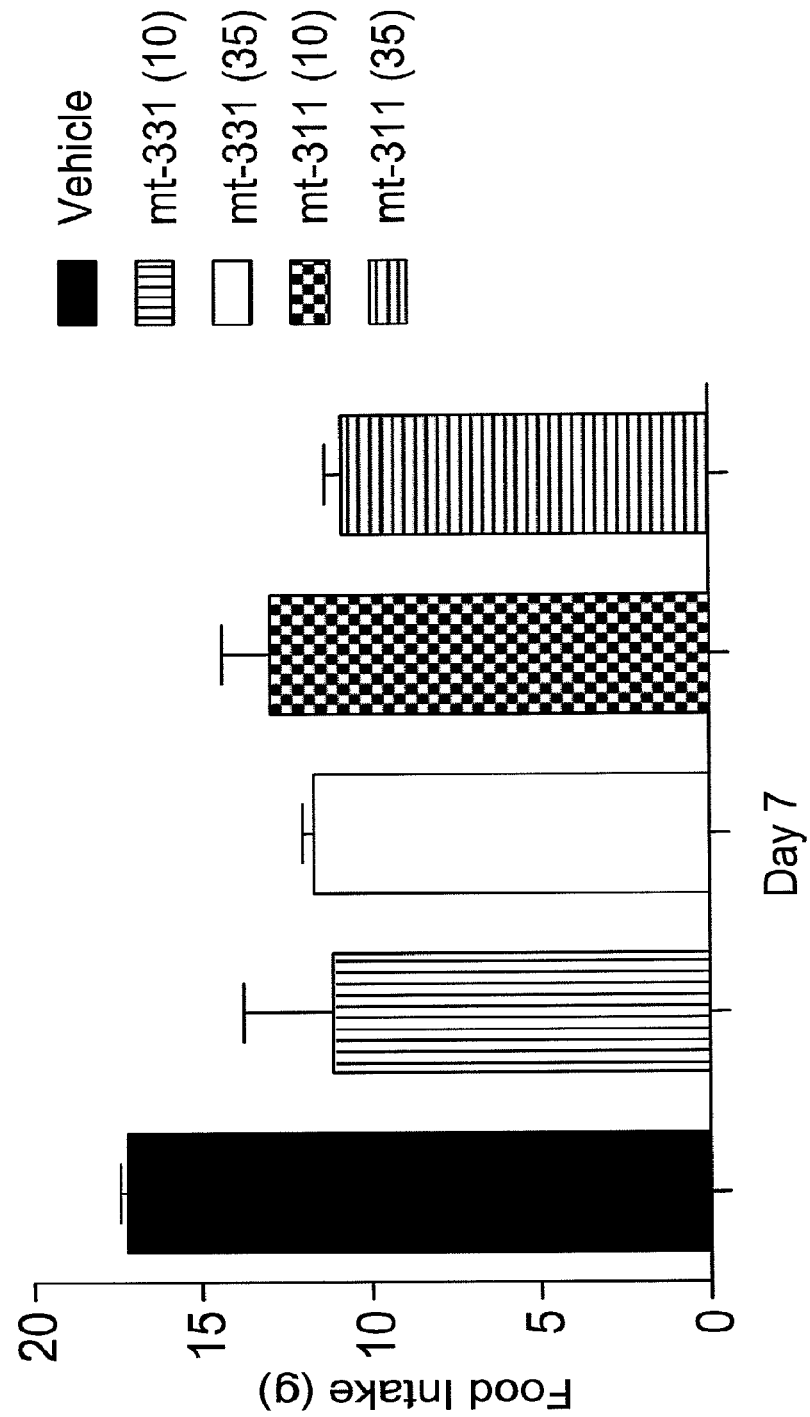
FIG. 23 represents a graph of the total food intake (g) by mice as measured 7 days after administration of mt-331, mt-311, or a vehicle control. Doses (nmol/kg) are indicated in ( ).
Figure 24:
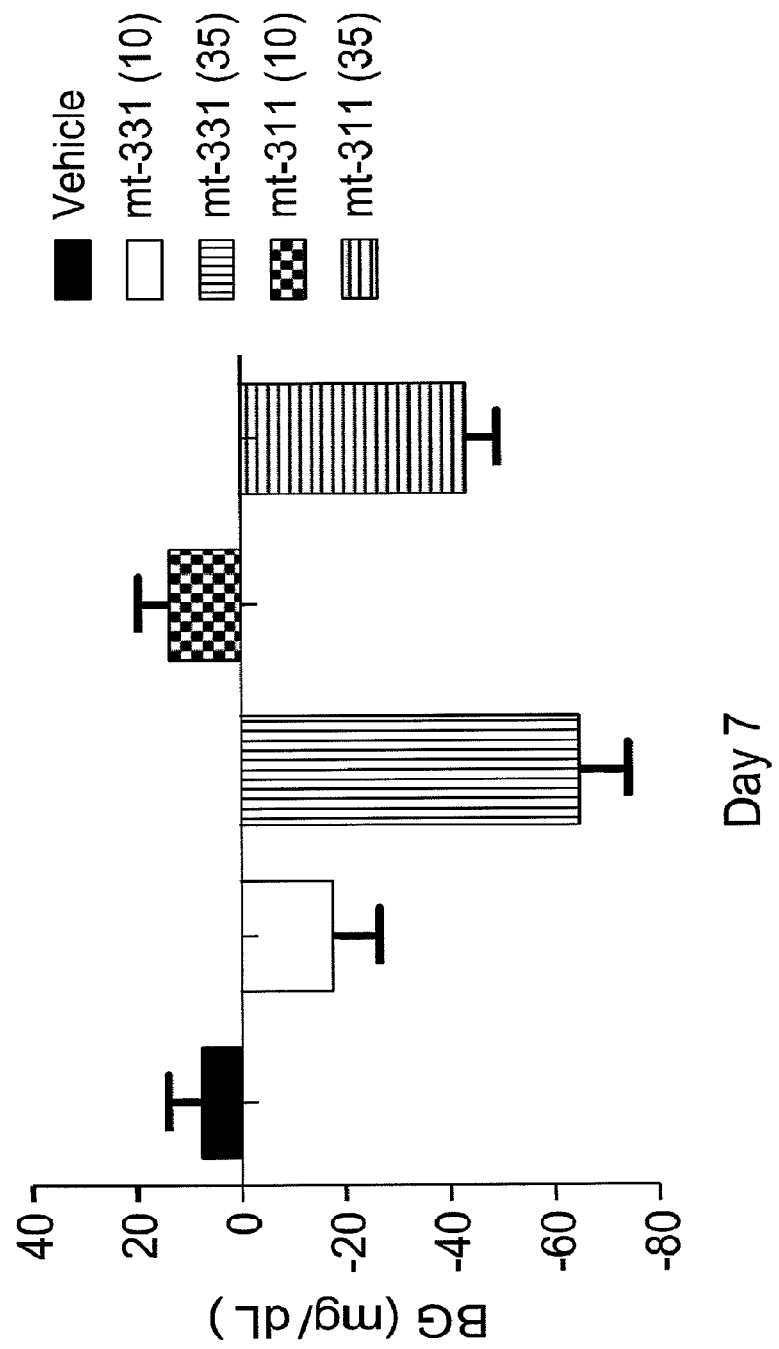
FIG. 24 represents a graph of the total change in blood glucose levels of mice as measured 7 days after administration of mt-331, mt-311, or a vehicle control. Doses (nmol/kg) are indicated in ( ).
Figure 25:
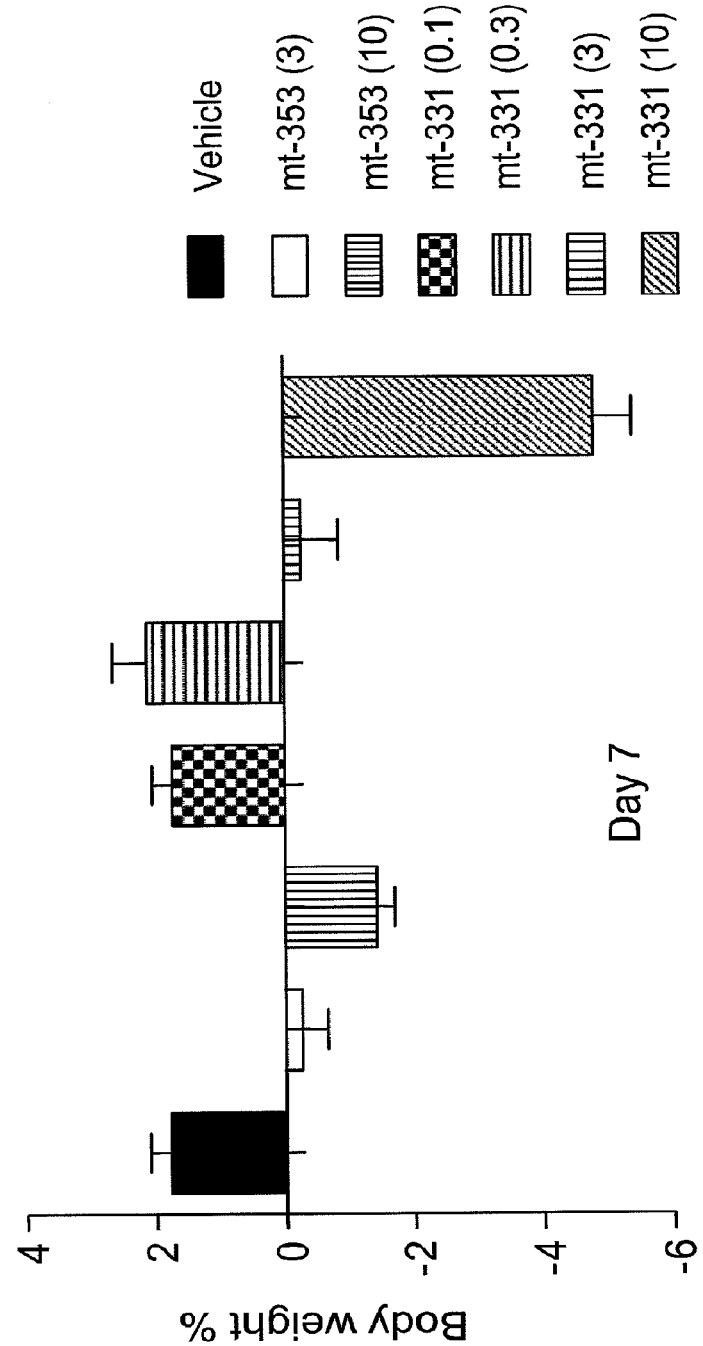
FIG. 25 represents a graph of the total change in body weight of mice as measured 7 days after administration of mt-331, mt-353, or a vehicle control at the indicated dose (nmol/kg) shown in ( ).
Figure 26:
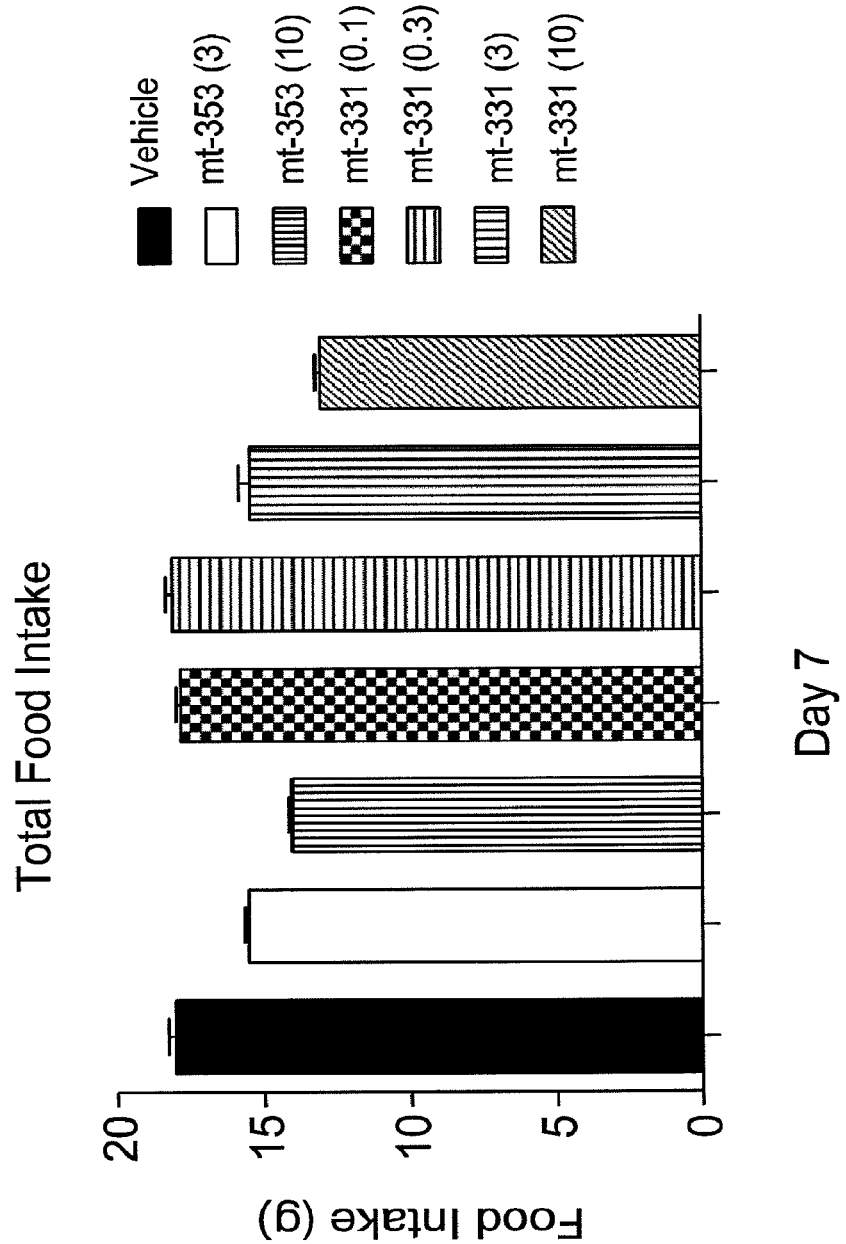
FIG. 26 represents a graph of the total food intake (g) by mice as measured 7 days after administration of mt-331, mt-353, or a vehicle control at the indicated dose (nmol/kg) shown in ( ).
Figure 27:
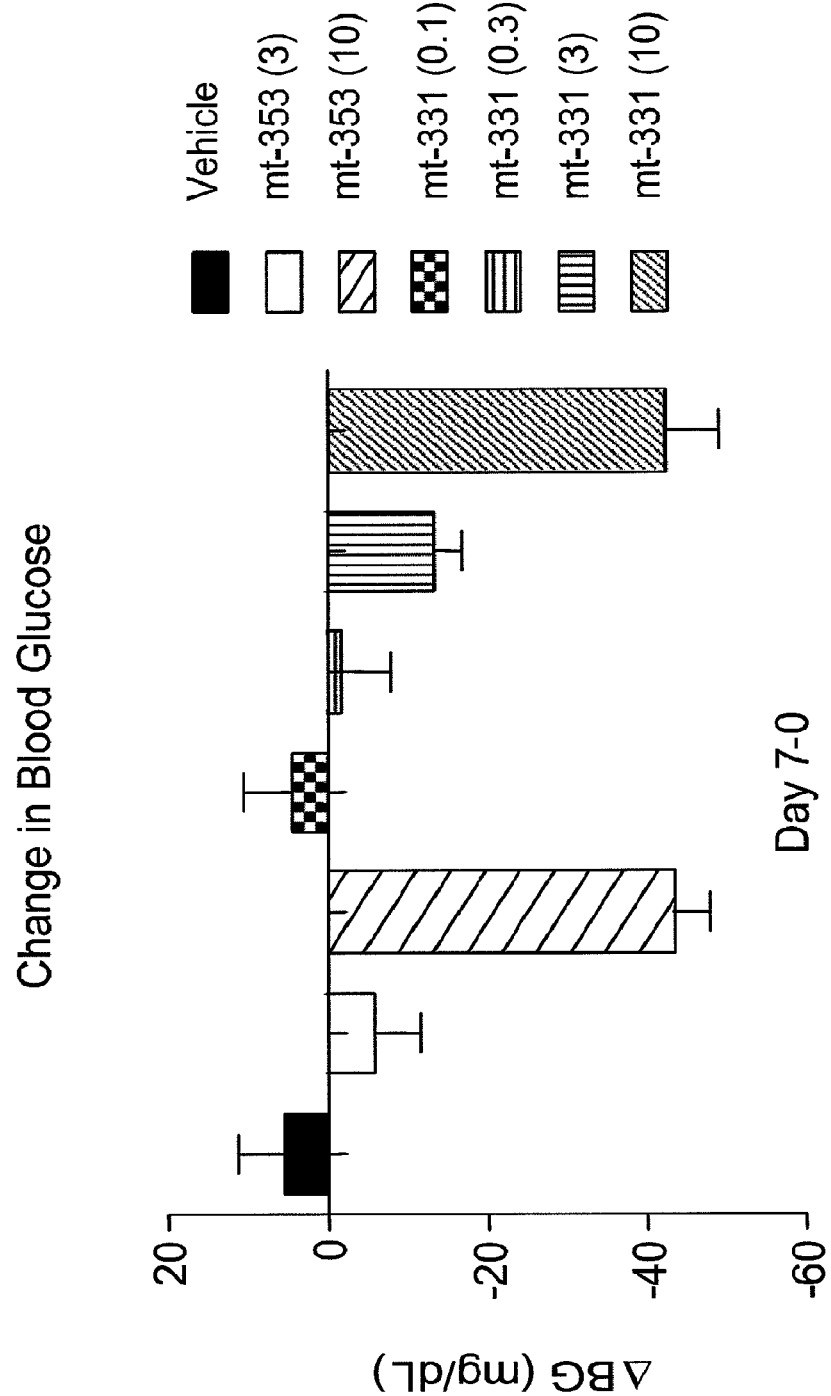
FIG. 27 represents a graph of the change in blood glucose levels (mg/dL) of mice as measured 7 days after administration of mt-331, mt-353, or a vehicle control at the indicated dose (nmol/kg) shown in ( ).
Figure 28:
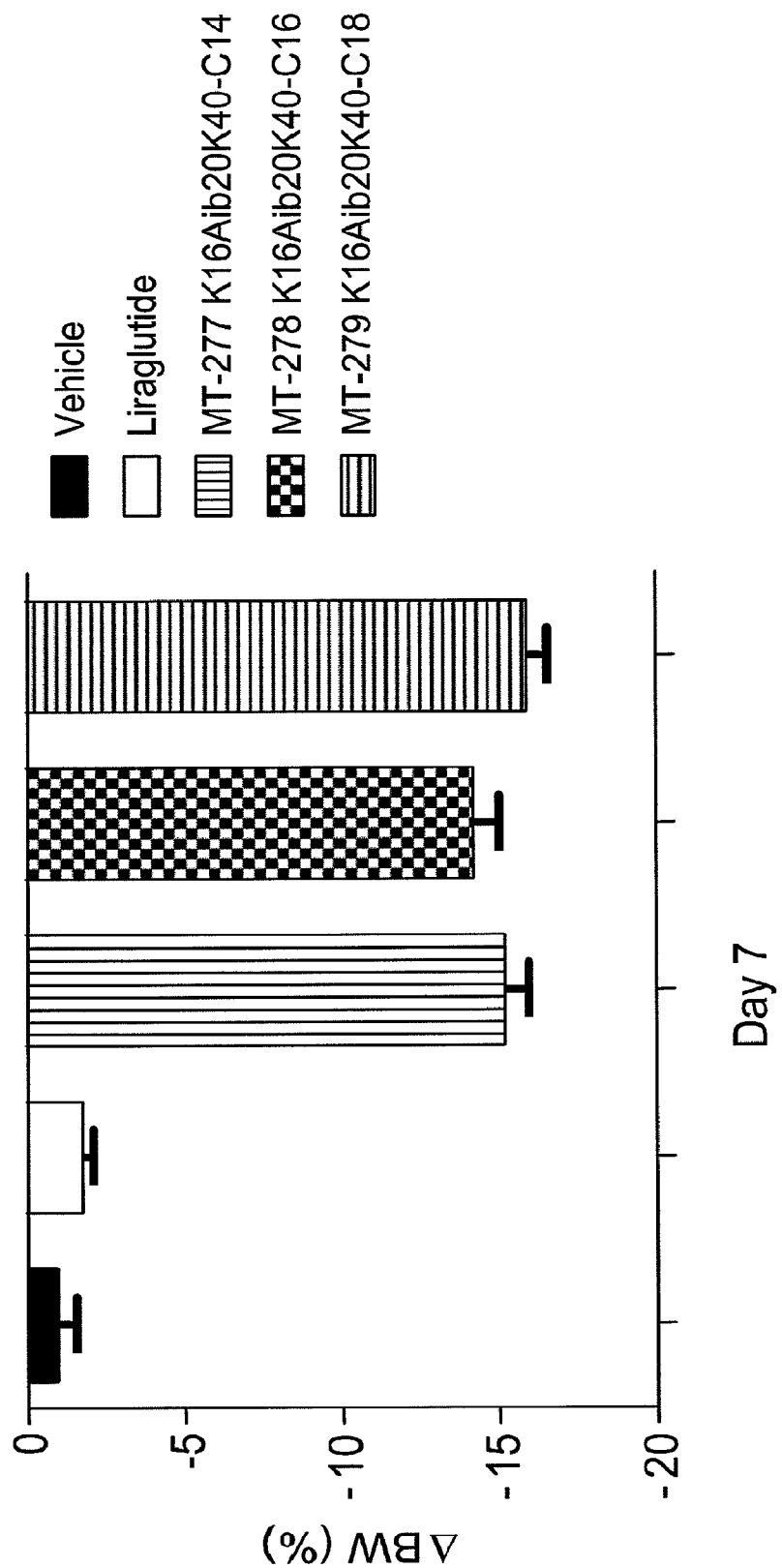
FIG. 28 represents a graph of the total change in body weight (%) of mice as measured 7 days after the first administration of mt-277, mt-278, mt-279, or a vehicle control.
Figure 29:
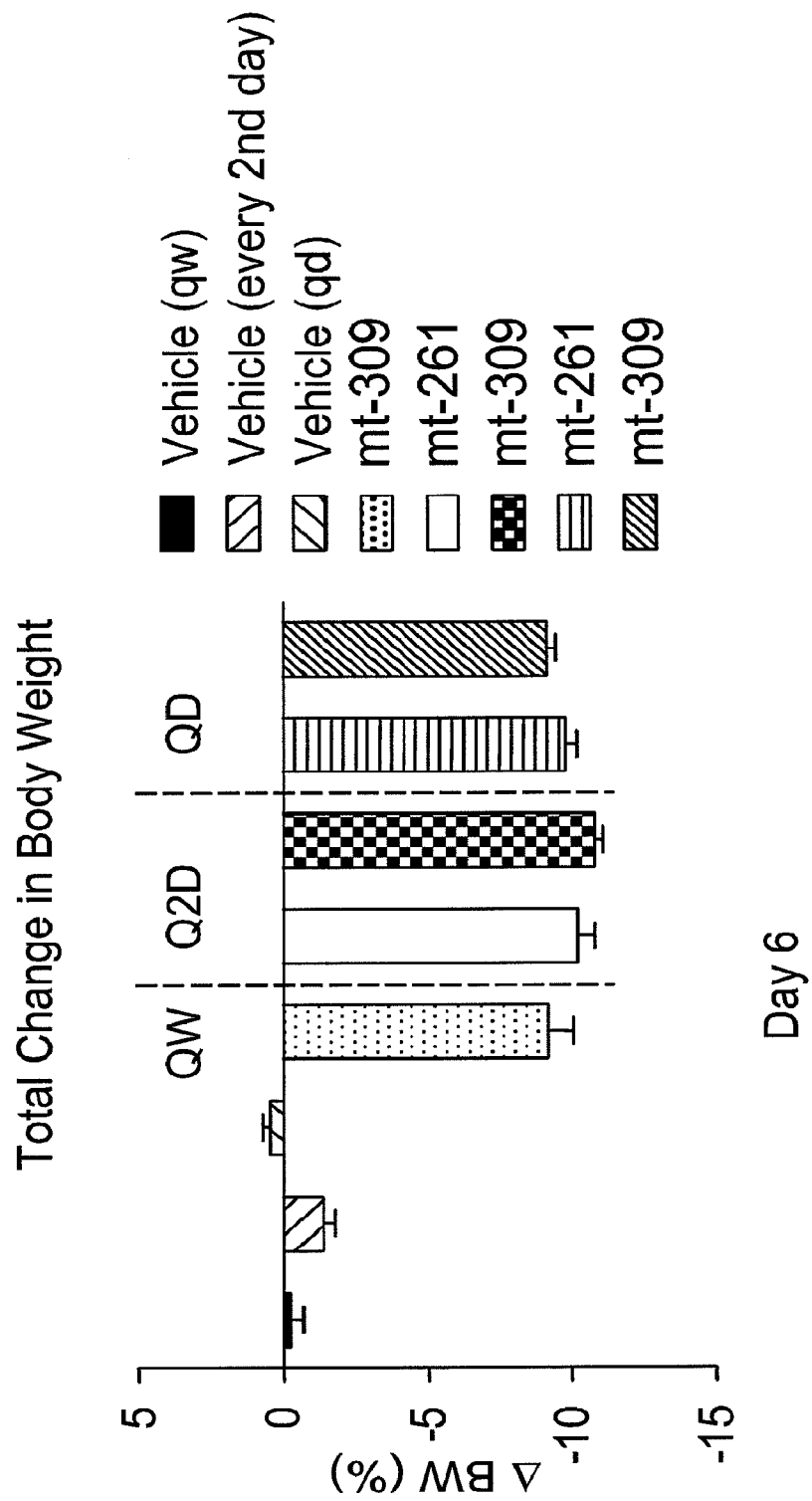
FIG. 29 represents a graph of the total change in body weight (%) of mice as measured 6 days after the first administration of mt-261, mt-309, or a vehicle control.
Figure 30:
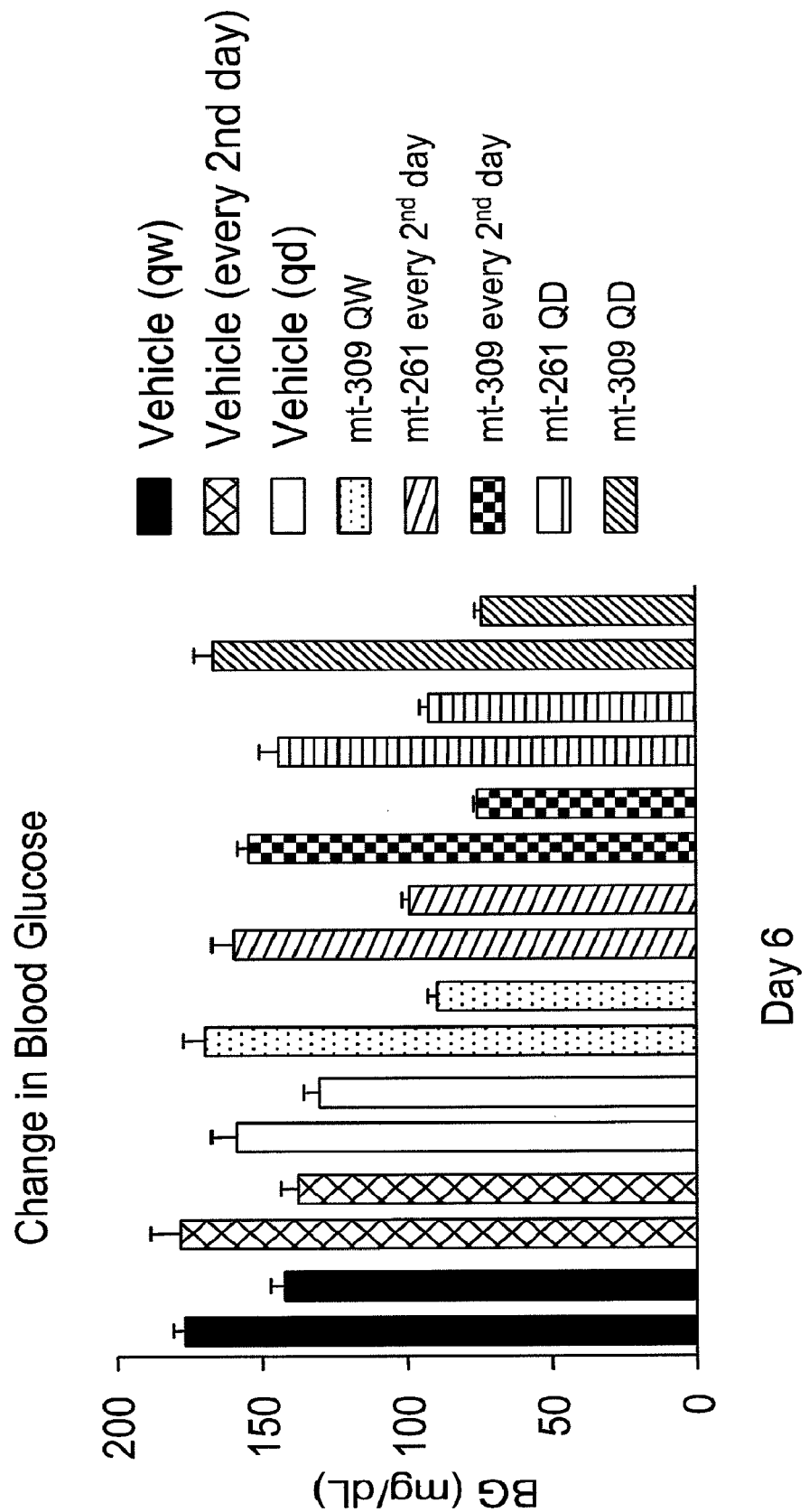
FIG. 30 represents a graph of the blood glucose levels (mg/dL) of mice as measured 6 days after the first administration of mt-261, mt-309, or a vehicle control. The first bar of each pair of bars of the same pattern is the blood glucose levels as measured on Day 0 and the second bar of each pair is the levels on Day 6.
Figure 31:
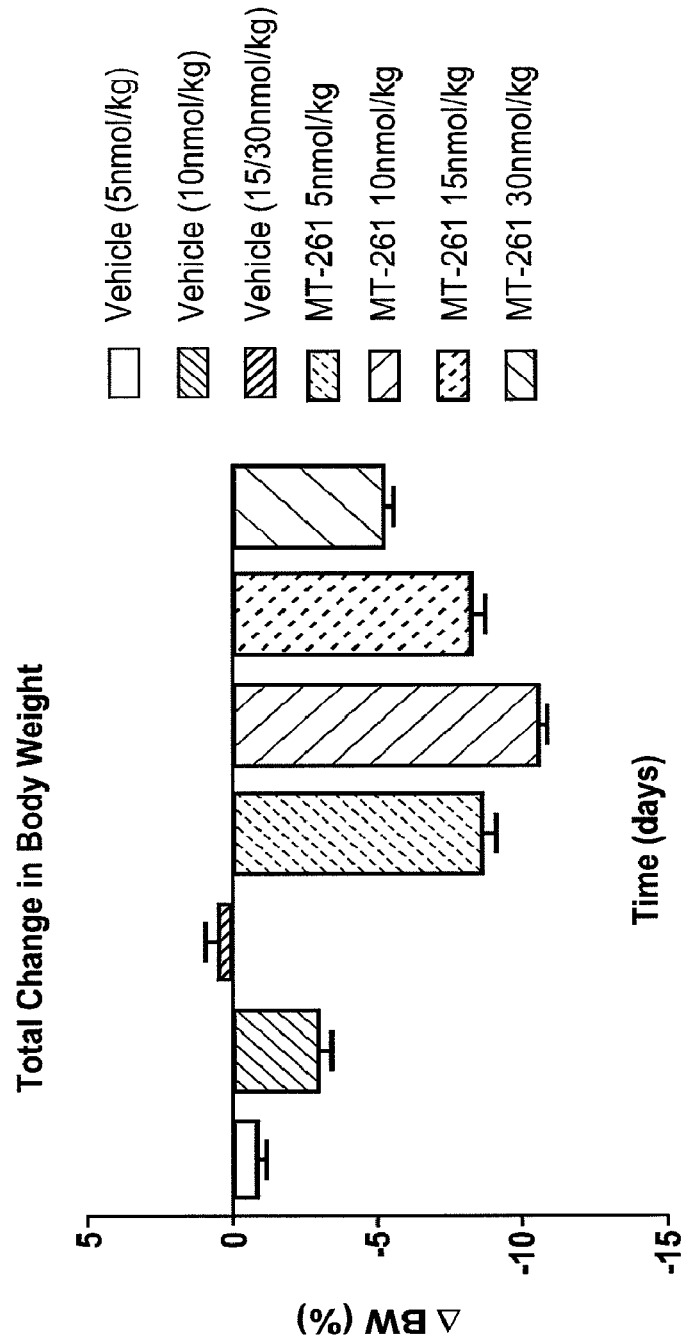
FIG. 31 represents a bar graph of the total change in body weight (%) as measured 6 days after the first administration of mt-261 (in comparison to the body weight as measured on the first day of administration) of mice injected with a vehicle control or mt-261 as further described herein.
Figure 32:
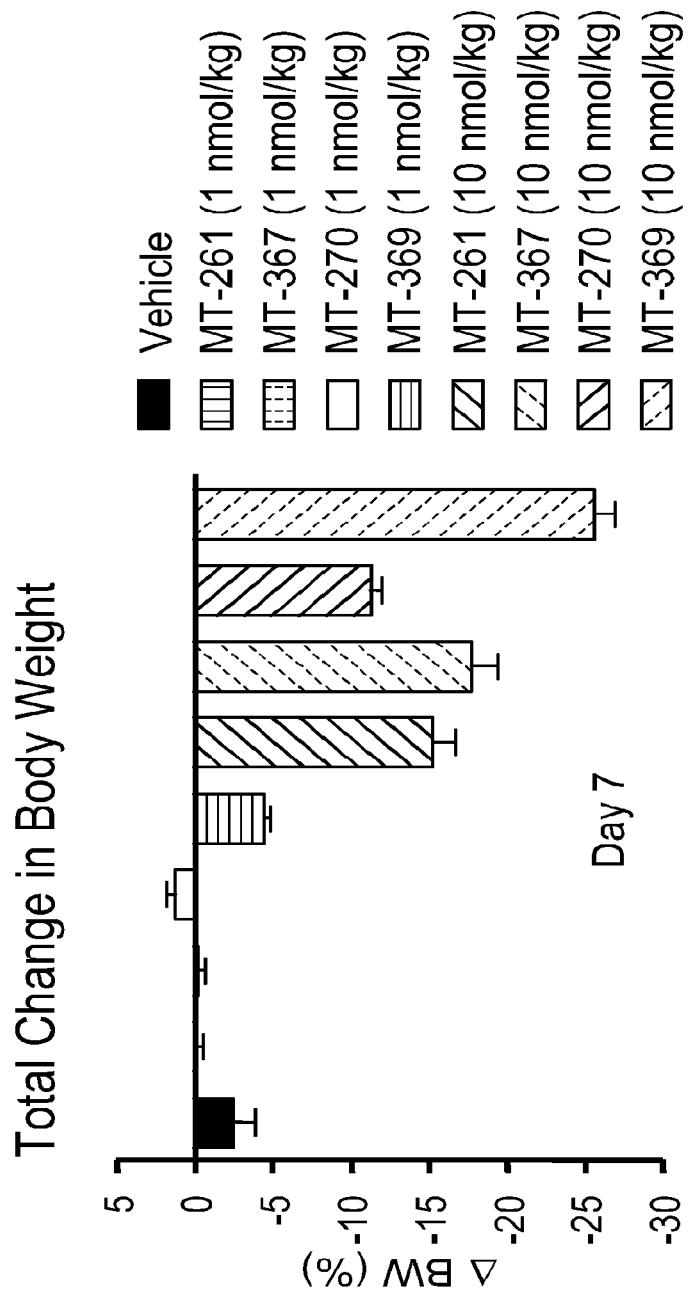
FIG. 32 represents a graph of the total change in body weight (%) of mice injected with different acylated peptides (MT-261, MT-367, MT-270, and MT-369) as calculated by subtracting the body weight on Day 0 from the body weight on Day 7.
Figure 33:
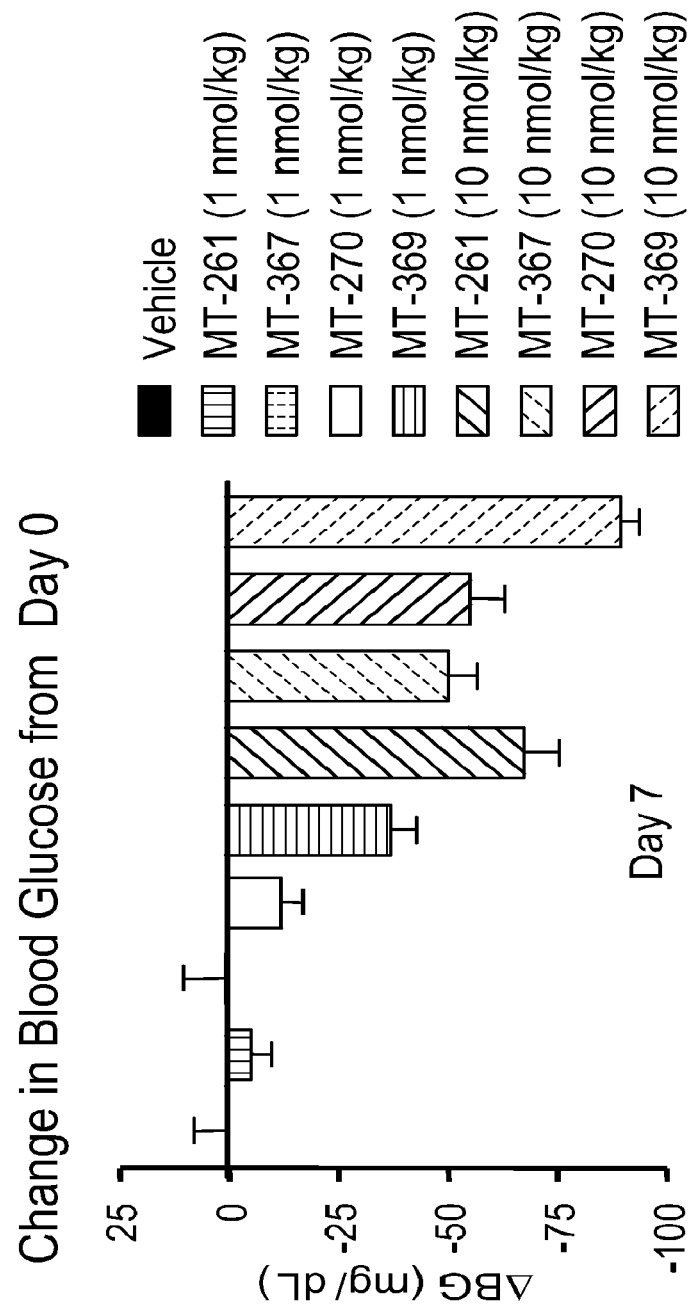
FIG. 33 represents a graph of the total change in blood glucose levels of mice injected with different acylated peptides (MT-261, MT-367, MT-270, and MT-369) as calculated by subtracting the blood glucose levels on Day 0 from that on Day 7.
Figure 34:
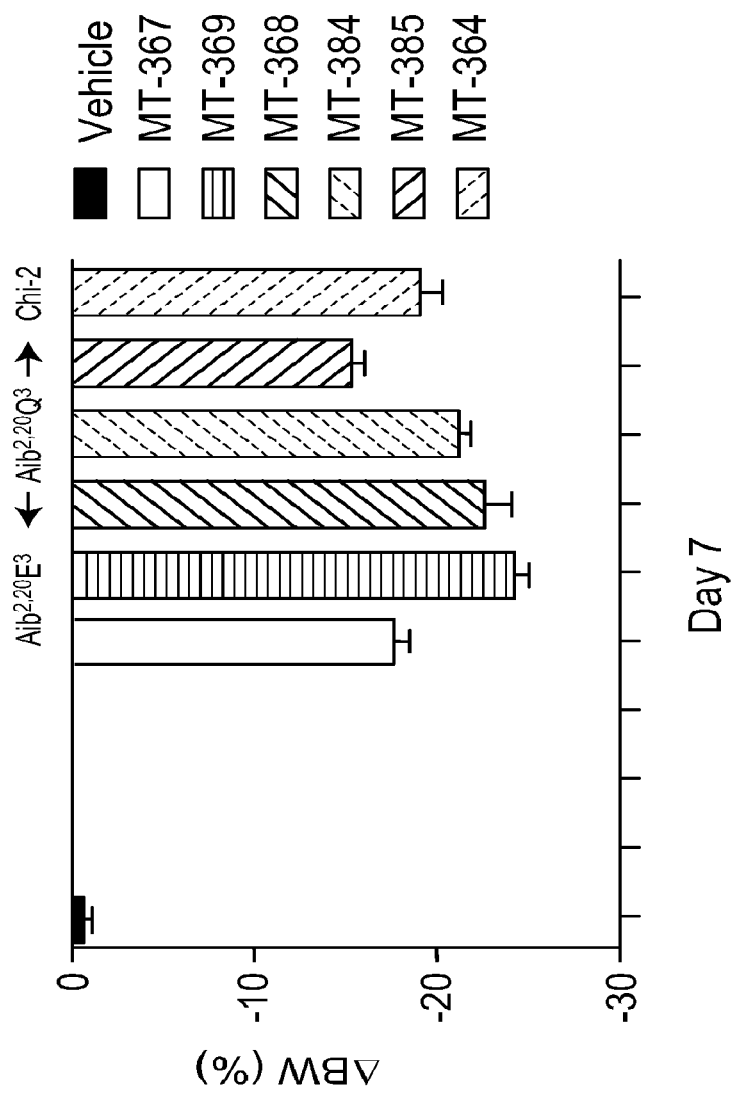
FIG. 34 represents a graph of the total change in body weight (%) of mice injected with MT-367, MT-369, MT-368, MT-384, MT-385, or MT-364 as calculated by subtracting the body weight on Day 0 from the body weight on Day 7.
Figure 35:
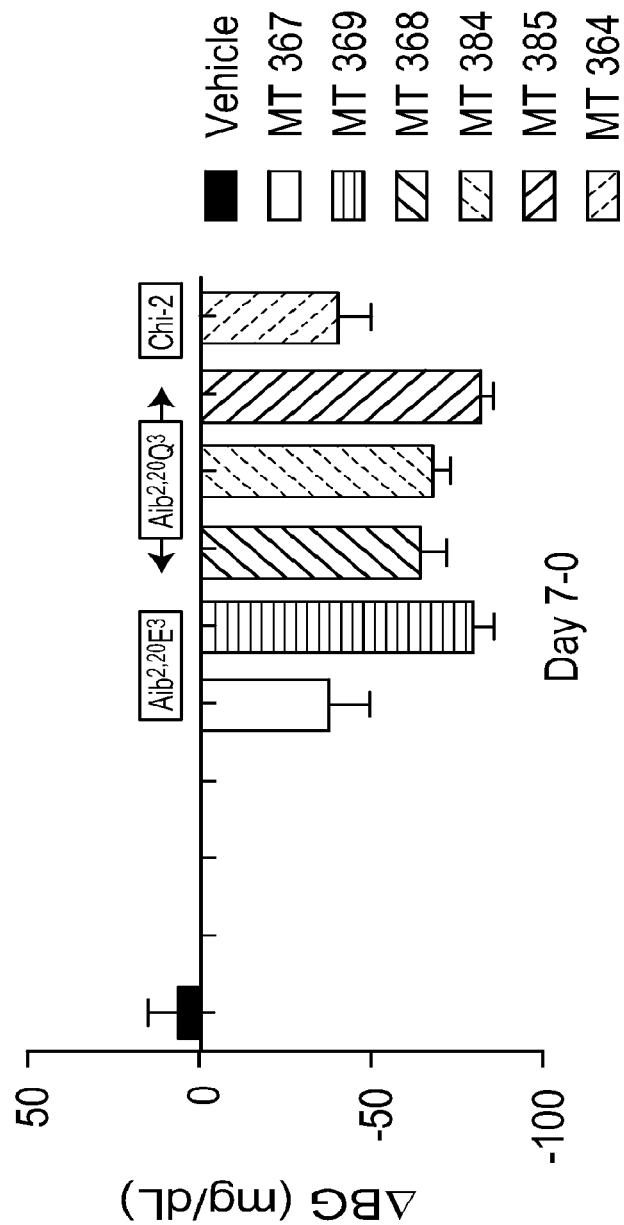
FIG. 35 represents a graph of the total change in blood glucose levels of mice injected with MT-367, MT-369, MT-368, MT-384, MT-385, or MT-364 as calculated by subtracting the blood glucose levels on Day 0 from that on Day 7.
Figure 36:
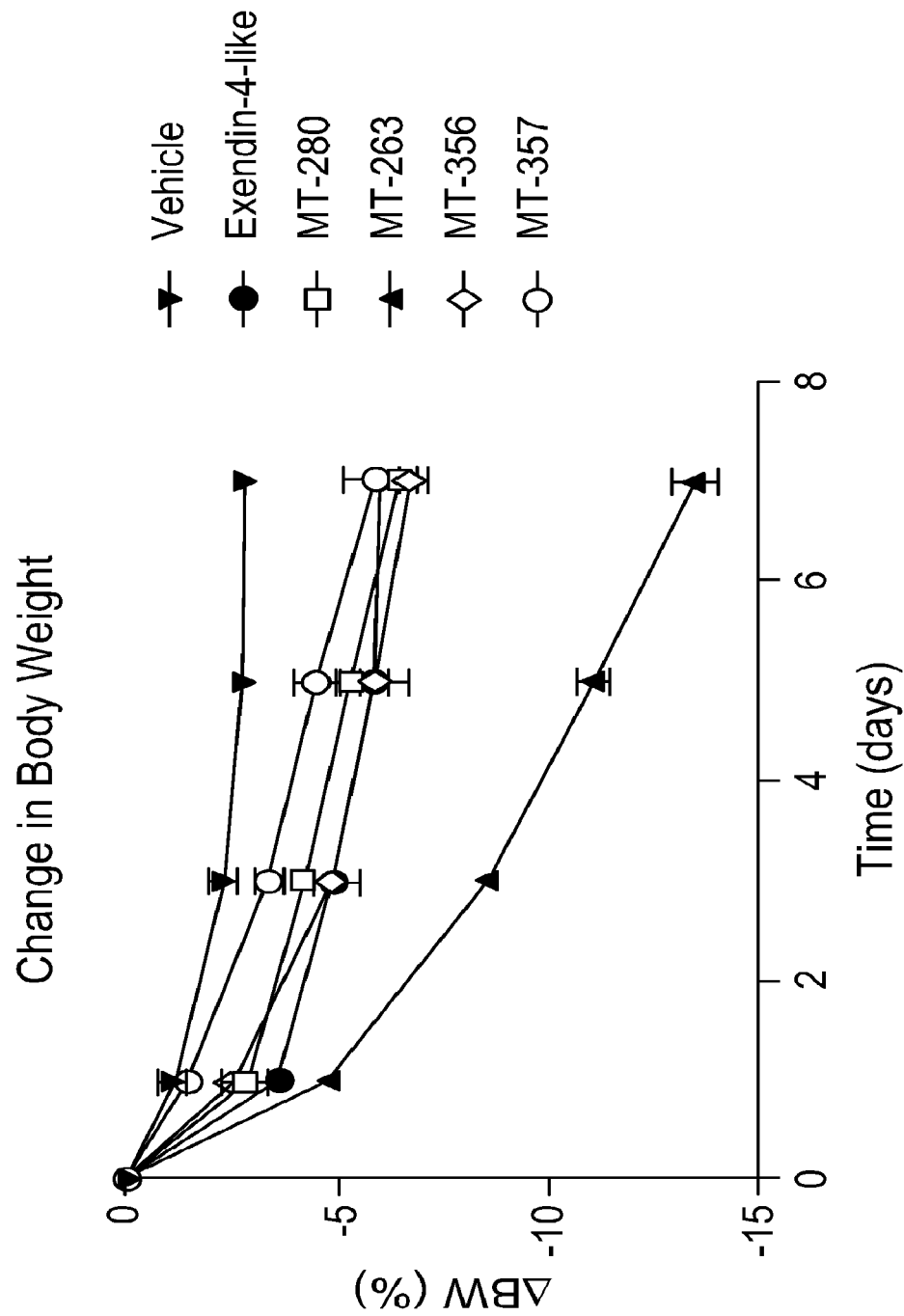
FIG. 36 represents a graph of the change in body weight (%) of mice injected with an Exendin-4-like peptide or with MT-263, MT-280, MT-356, or MT-357, or with a vehicle control, as a function of time (days).
Figure 37:
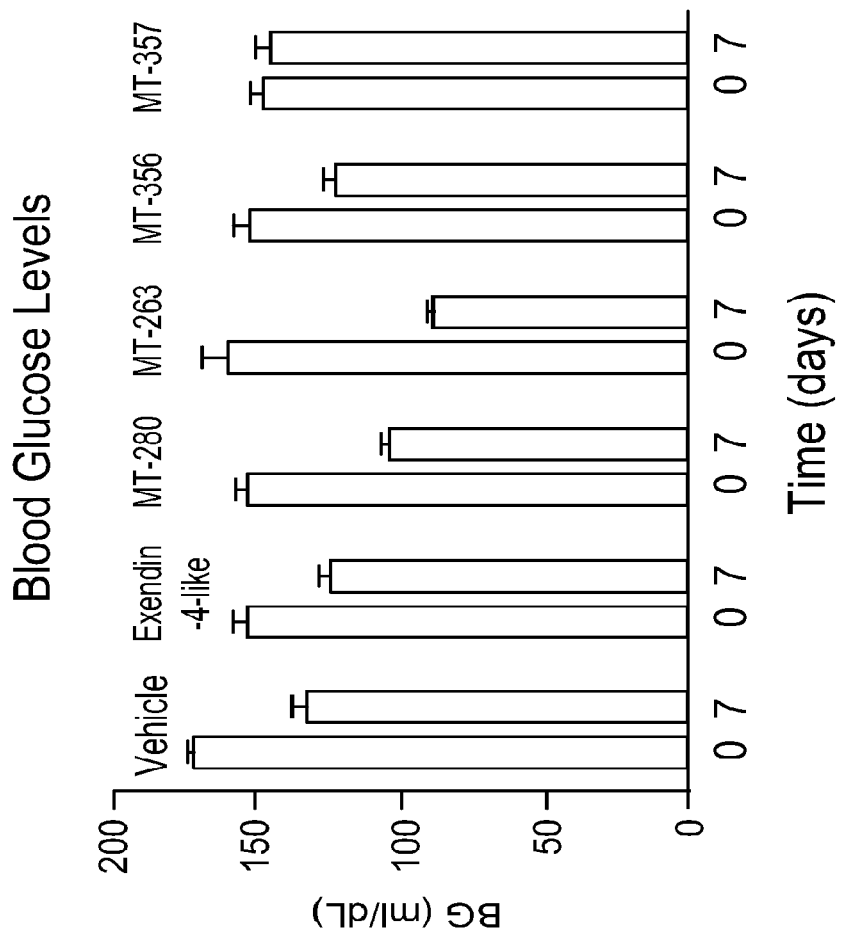
FIG. 37 represents a graph of a graph of the blood glucose levels (ml/dL) of mice injected with an Exendin-4-like peptide or with MT-263, MT-280, MT-356, or MT-357, or with a vehicle control, as measured on Day 0 and Day 7 of the study.
Figure 38:
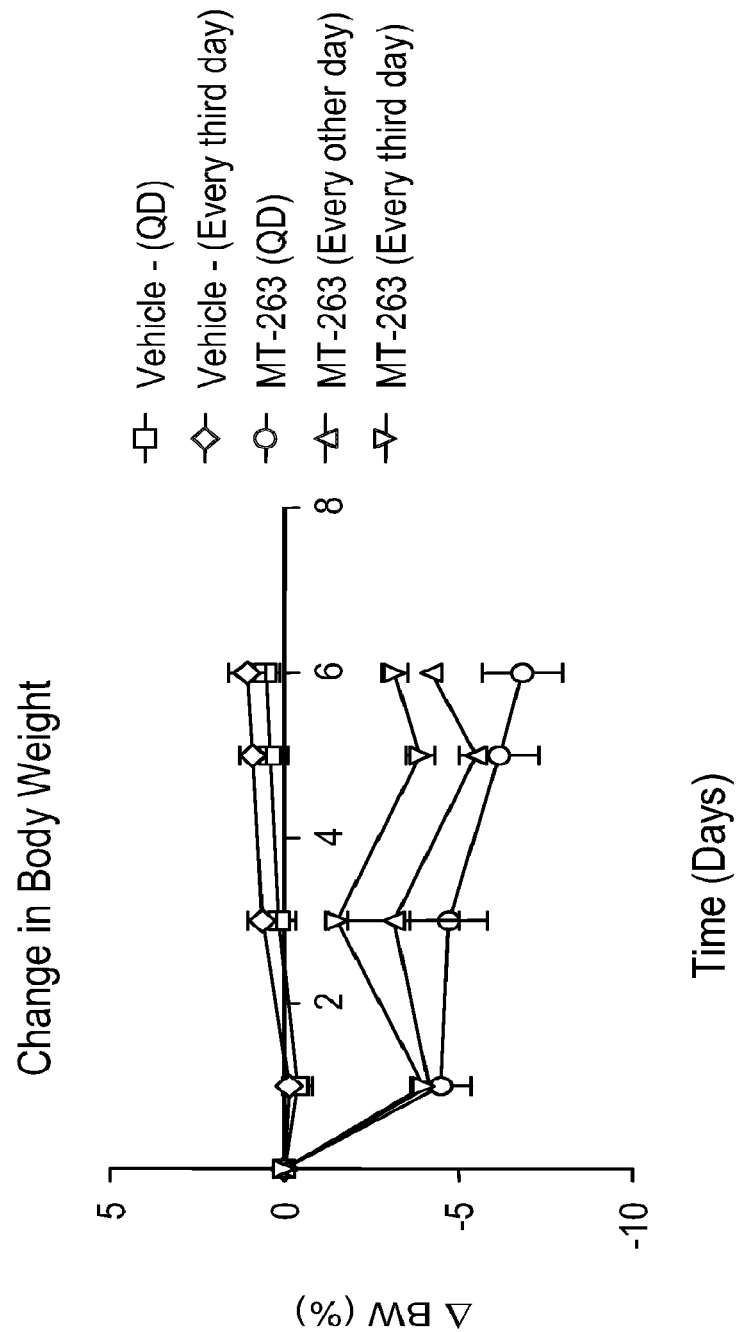
FIG. 38 represents a graph of the % change in body weight of mice injected with vehicle only (daily or once every 3 days) or MT-263 (daily, once every 2 days, or once every 3 days).
Figure 39:
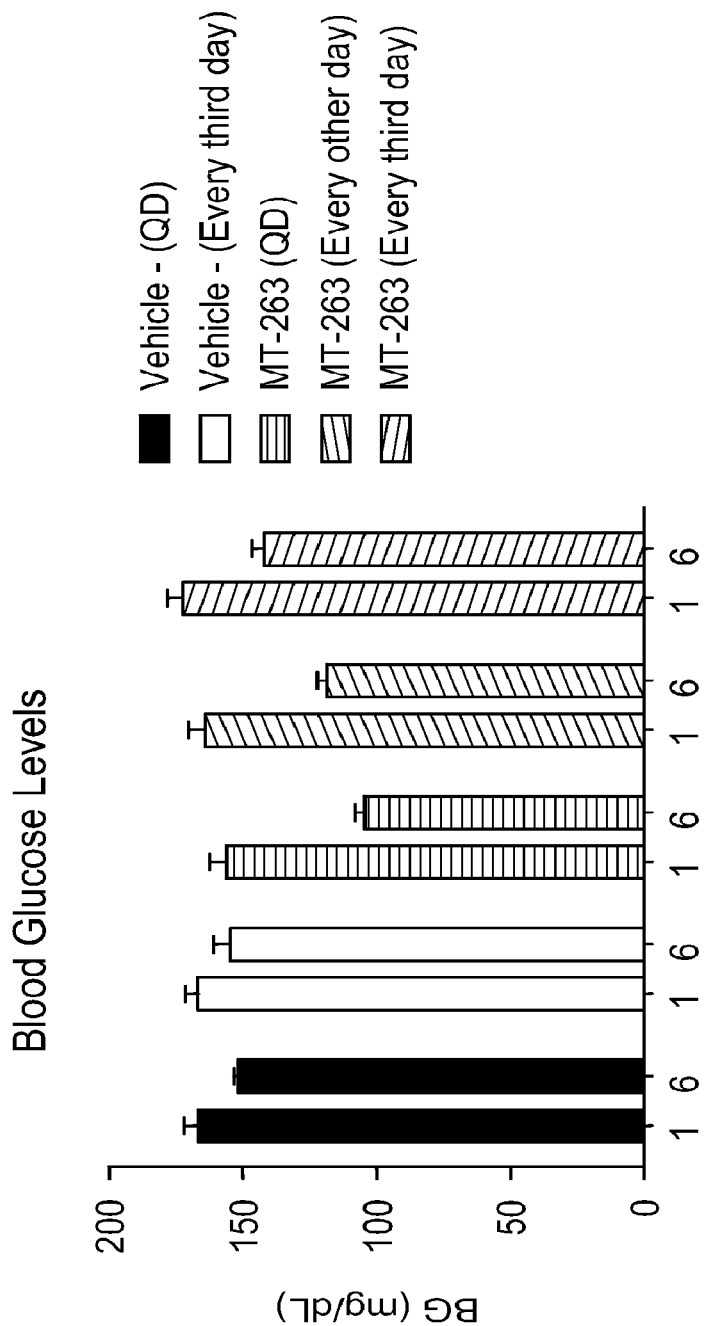
FIG. 39 represents a graph of the blood glucose levels as measured on Days 1 and 6 of the study of mice injected with vehicle only (daily or once every 3 days) or MT-263 (daily, once every 2 days, or once every 3 days).

As shown in FIG. 8, the biggest decrease in blood glucose levels was observed in mice injected with MT-263 on a daily basis.

Example 11

Acylated or pegylated compounds were subcutaneously injected into DIO mice (N=8; 7 mice per group) having an initial body weight of 57.4 g. The acylated compounds were injected daily at a dose of 10 nmol/kg, whereas the pegylated compounds were injected QW at a dose of 10 nmol/kg. Body weight, food intake, blood glucose levels, and fat mass were monitored throughout the study.

TABLE 8

| Peptide | SEQ ID NO: | Peptide Name | % Relative Activity GLP-1R | at GR | at GIPR |
|---|---|---|---|---|---|
| Exendin-4-like peptide | 37 | | 312 | 0.01 | 0.01 |
| MT-263 | 211 | Y1Aib2E3I12K16Q17A18Aib20E21N24-LAG27-29-CEX-K | 169 | 0.74 | 225 |
| MT-280 | 226 | Y1Aib2I12K16Q17A18Aib20E21N24-LAG27-29-CEX-K | 225 | 60 | 154 |
| MT-356 | 332 | Y1Aib2E3I12K16Q17A18Aib20E21N24-CEX-K | 221 | 82 | 25 |
| MT-357 | 333 | Y1Aib2I7I12K16Q17A18Aib20E21N24-LAG27-29-CEX-K | 0.81 | 170 | 198 |

Table 9 provides the in vitro activities and structural features of the peptides used in this study.

TABLE 9

| Peptide | SEQ ID NO: | Peptide Name | % Relative Activity | | |
|---|---|---|---|---|---|
| | | | GLP-1R | at GR | at GIPR |
| MT-270 | 218 | E3K10-C16 | 211.8 | 0.06 | 163.3 |
| MT-341 | 262 | E3C24-PEG-K10-C14 | 14.6 | 0.01 | 27.4 |
| MT-261 | 205 | E3K40-C16 | 372.3 | 13.4 | 700 |
| MT-353 | 266 | E3C24-PEG-K40-C14 | 128.6 | 0.17 | 102.9 |
| MT-278 | 224 | K40-C16 | 459.5 | 588.4 | 846.4 |
| MT-290 | 236 | C24-PEG-K40-C14 | 156.4 | 113.8 | 23.7 |

Figure 40:
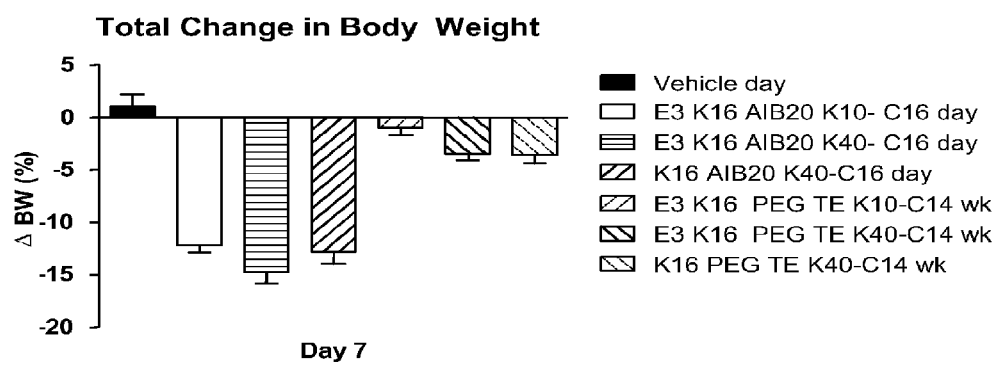
FIG. 40 represents a graph of the total change in body weight observed in mice upon administration with acylated or pegylated compounds as further described herein.
Figure 41:
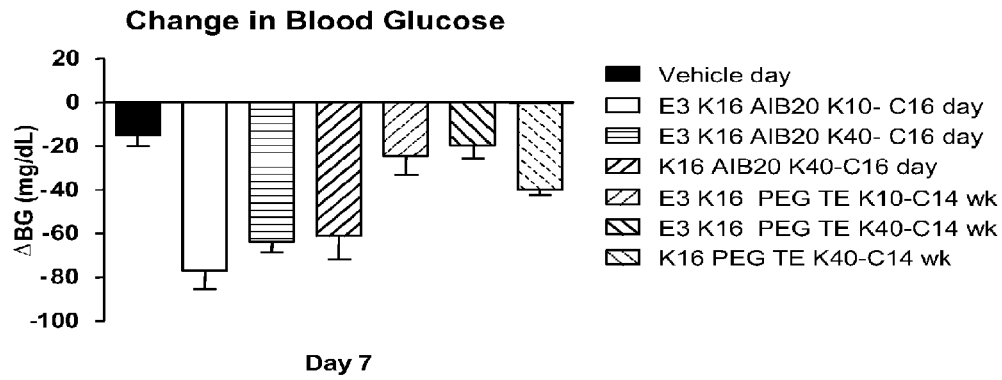
FIG. 41 represents a graph of the change in blood glucose observed in mice upon administration with acylated or pegylated compounds as further described herein.

FIGS. 40 and 41 demonstrate the results of the changes in body weight and blood glucose levels upon administration of the peptides.

Example 12

Figure 42:
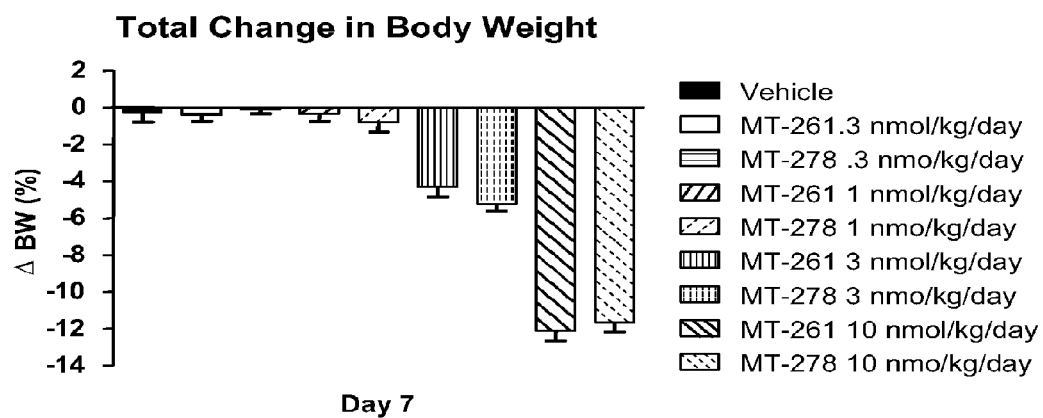
FIG. 42 represents a graph of the total change in body weight observed in mice upon administration of MT-261 or MT-278 as further described herein.
Figure 43:
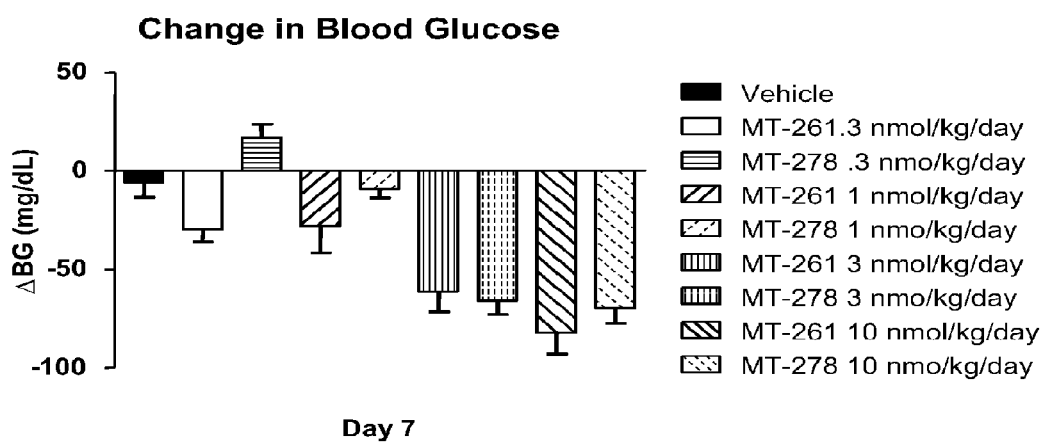
FIG. 43 represents a graph of the change in blood glucose observed in mice upon administration of MT-261 or MT-278 as further described herein.

Peptides MT-261 (SEQ ID NO: 205) and MT-278 (SEQ ID NO: 224) (at doses: 0.3, 1, 3, or 10 nmol/kg/day) were administered to mice as essentially described herein and body weight, food intake, and blood glucose levels were monitored. FIGS. 42 and 43 demonstrate the results of the changes in body weight and blood glucose levels, respectively.

Example 13

Several peptides were made as essentially described herein and the structures of each can be found in Sequence Listing 2. The in vivo effects of each peptide were tested in mice as essentially described herein. FIGS. 1-31 provide the results of the in vivo assays.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted.

Recitation of ranges of values herein are merely intended to serve as a shorthand method of referring individually to each separate value falling within the range and each endpoint, unless otherwise indicated herein, and each separate value and endpoint is incorporated into the specification as if it were individually recited herein.

All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Preferred embodiments of this invention are described herein, including the best mode known to the inventors for carrying out the invention. Variations of those preferred embodiments may become apparent to those of ordinary skill in the art upon reading the foregoing description. The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context.

SEQUENCE LISTING (1334 sequences)

SEQ ID NO: 1 - protein, 29 aa, Homo sapiens
HSQGTFTSDYSKYLDSRRAQDFVQWLMNT

SEQ ID NO: 2 - protein, 42 aa, Homo sapiens
YAEGTFISDYSIAMDKIHQQDFVNWLLAQKGKKNDWKHNITQ

SEQ ID NO: 3 - protein, 10 aa, Artificial Sequence
  Synthetic peptide
GPSSGAPPPS

SEQ ID NO: 4 - protein, 11 aa, Artificial Sequence
  Synthetic peptide
  MOD_RES (1)..(1): Xaa can be any amino acid
XGPSSGAPPPS

SEQ ID NO: 5 - protein, 10 aa, Artificial Sequence
  Synthetic peptide
GPSSGAPPPK

SEQ ID NO: 6 - protein, 11 aa, Artificial Sequence
  Synthetic peptide
  MOD_RES (1)..(1): Xaa can be any amino acid
XGPSSGAPPPK

SEQ ID NO: 7 - protein, 12 aa, Artificial Sequence
  Synthetic peptide
  misc_feature (1)..(1): Xaa can be any naturally occurring amino acid
XGPSSGAPPPSK

SEQ ID NO: 8 - protein, 8 aa, Artificial Sequence
  Synthetic peptide
KRNRNNIA

SEQ ID NO: 9 - protein, 4 aa, Artificial Sequence
  Synthetic peptide
KRNR

SEQ ID NO: 10 - protein, 24 aa, Artificial Sequence
  Synthetic peptide
  MISC_FEATURE (1)..(24): Peptide A1
  MOD_RES (1)..(1): Alpha-amine replaced with hydroxyl group
  MOD_RES (24)..(24): C-terminal amidation
FTSEYSKYLDSRRAQDFVCWLMNT

SEQ ID NO: 11 - protein, 24 aa, Artificial Sequence
  Synthetic peptide
  MISC_FEATURE (1)..(24): Peptide A2
  MOD_RES (1)..(1): Alpha-amine replaced with hydroxyl group
  MOD_RES (24)..(24): C-terminal amidation
FTSDYSKYLDERRAKDFVCWLMDT

SEQ ID NO: 12 - protein, 29 aa, Artificial Sequence
  Synthetic peptide
  MISC_FEATURE (1)..(29): Peptide A3
  MOD_RES (2)..(2): Xaa is AIB
  MISC_FEATURE (5)..(6): Linked via ester bond
  MOD_RES (29)..(29): C-terminal amidation
HXEGTFTSDYSKYLDERRAKDFVCWLMDT

SEQ ID NO: 13 - protein, 29 aa, Artificial Sequence
  Synthetic peptide
  MISC_FEATURE (1)..(29): Peptide A4
  MOD_RES (2)..(2): Xaa is AIB
  MISC_FEATURE (5)..(6): Linked via ester bond
  MISC_FEATURE (10)..(10): Acylated with C16 fatty acyl group via gamma-Glu-gamma-Glu spacer
  MOD_RES (29)..(29): C-terminal amidation
HXEGTFTSDKSKYLDERRAKDFVCWLMDT

SEQ ID NO: 14 - protein, 29 aa, Artificial Sequence
  Synthetic peptide
  MISC_FEATURE (1)..(29): Peptide A4'
  MOD_RES (2)..(2): Xaa is AIB
  MISC_FEATURE (5)..(6): Linked via ester bond
  MISC_FEATURE (10)..(10): Acylated with a C16 fatty acyl group via dipeptide spacer comprising two acidic amino acids
  MOD_RES (29)..(29): C-terminal amidation
HXEGTFTSDKSKYLDERRAKDFVCWLMDT

SEQ ID NO: 15 - protein, 40 aa, Artificial Sequence
  Synthetic peptide
  MISC_FEATURE (1)..(40): Peptide A5
  MOD_RES (2)..(2): Xaa is AIB
  MISC_FEATURE (5)..(6): Linked via ester bond
  MISC_FEATURE (40)..(40): Acylated with a C16 fatty acyl group via gamma-Glu-gamma-Glu spacer
  MOD_RES (40)..(40): C-terminal amidation
HXEGTFTSDYSKYLDERRAKDFVCWLMDGGPSSGAPPPSK

SEQ ID NO: 16 - protein, 40 aa, Artificial Sequence; identical to SEQ ID NO: 15
  Synthetic peptide
  MISC_FEATURE (1)..(40): Peptide A5'
  MOD_RES (2)..(2): Xaa is AIB
  MISC_FEATURE (5)..(6): Linked via ester bond
  MISC_FEATURE (40)..(40): Acylated with C16 fatty acyl group via dipeptide spacer comprising two acid amino acids
  MOD_RES (40)..(40): C-terminal amidation

SEQ ID NO: 17 - protein, 40 aa, Artificial Sequence
  Synthetic peptide
  MISC_FEATURE (1)..(40): Peptide B1
  MOD_RES (2)..(2): Xaa is AIB
  MOD_RES (40)..(40): Epsilon amine attached to carboxyate of hydrophobic bifunctional linker
  MOD_RES (40)..(40): C-terminal amidation
AXEGTFISDYSIAMDKIHQQDFVNWLLAGGPSSGAPPPSK

SEQ ID NO: 18 - protein, 40 aa, Artificial Sequence
  Synthetic peptide
  MISC_FEATURE (1)..(40): Peptide B2
  MOD_RES (2)..(2): Xaa is AIB
  MOD_RES (20)..(20): Xaa is AIB
  MOD_RES (40)..(40): Epsilon amine attached to carboxyate of hydrophobic bifunctional linker
  MOD_RES (40)..(40): C-terminal amidation
AXEGTFTSDYSIYLDKQAAXEFVNWLLAGGPSSGAPPPSK

SEQ ID NO: 19 - protein, 39 aa, Artificial Sequence
  Synthetic peptide
  MISC_FEATURE (1)..(39): mt-217
  MOD_RES (2)..(2): Xaa is AIB
  MISC_FEATURE (16)..(20): Lactam bridge
  MOD_RES (24)..(24): Epsilon amine is peptide bonded to Ala residue which is attached to an acetylated Cys which is attached to a 40kDa PEG
  MOD_RES (39)..(39): C-terminal amidation
YXQGTFTSDYSIYLDEQAAKEFVKFLLAGGPSSGAPPPS

SEQ ID NO: 20 - protein, 39 aa, Artificial Sequence; identical to SEQ ID NO: 19
  Synthetic peptide
  MISC_FEATURE (1)..(39): mt-218
  MOD_RES (2)..(2): Xaa is AIB
  MISC_FEATURE (16)..(20): Lactam bridge
  MISC_FEATURE (24)..(24): Epsilon amine is peptide bonded to Glu residue which is attached to an acetylated Cys which is attached to a 40kDa PEG
  MISC_FEATURE (39)..(39): C-terminal amidation

SEQ ID NO: 21 - protein, 39 aa, Artificial Sequence; identical to SEQ ID NO: 19
  Synthetic peptide
  MISC_FEATURE (1)..(39): mt-219
  MOD_RES (2)..(2): Xaa is AIB
  MISC_FEATURE (16)..(20): Lactam bridge
  MOD_RES (24)..(24): Epsilon amine is peptide bonded to Arg residue which is attached to an acetylated Cys which is attached to a 40kDa PEG
  MOD_RES (39)..(39): C-terminal amidation

SEQ ID NO: 22 - protein, 39 aa, Artificial Sequence; identical to SEQ ID NO: 19
  Synthetic peptide
  MISC_FEATURE (1)..(39): mt-220
  MOD_RES (2)..(2): Xaa is AIB
  MISC_FEATURE (16)..(20): Lactam bridge
  MOD_RES (24)..(24): Epsilon amine is peptide bonded to Phe residue which is attached to an acetylated Cys which is attached to a 40kDa PEG
  MOD_RES (39)..(39): C-terminal amidation

SEQ ID NO: 23 - protein, 40 aa, Artificial Sequence
  Synthetic peptide
  MISC_FEATURE (1)..(40): mt-226
  MOD_RES (2)..(2): Xaa is AIB
  MISC_FEATURE (16)..(20): Lactam bridge
  MOD_RES (40)..(40): Epsilon amine is peptide bonded to Glu residue which is attached to an acetylated Cys which is attached to a 40kDa PEG
  MOD_RES (40)..(40): C-terminal amidation
YXQGTFTSDYSIYLDEQAAKEFVNWLLAGGPSSGAPPPSK

SEQ ID NO: 24 - protein, 40 aa, Artificial Sequence; identical to SEQ ID NO: 23
  Synthetic peptide
  MISC_FEATURE (1)..(40): mt-228
  MOD_RES (2)..(2): Xaa is AIB
  MISC_FEATURE (16)..(20): Lactam bridge
  MISC_FEATURE (40)..(40): Epsilon amine is peptide bonded to Phe residue which is attached to an acetylated Cys which is attached to a 40kDa PEG
  MISC_FEATURE (40)..(40): C-terminal amidation

SEQ ID NO: 25 - protein, 40 aa, Artificial Sequence
  Synthetic peptide
  MISC_FEATURE (1)..(40): mt-402
  MOD_RES (2)..(2): Xaa is AIB
  MOD_RES (20)..(20): Xaa is AIB
YXQGTFTSDYSIYLDKKAAXEFVNWLLAGGPSSGAPPPSK

SEQ ID NO: 26 - protein, 40 aa, Artificial Sequence; identical to SEQ ID NO: 25
  Synthetic peptide
  MISC_FEATURE (1)..(40): mt-403
  MOD_RES (2)..(2): Xaa is AIB
  MOD_RES (20)..(20): Xaa is AIB
  MOD_RES (40)..(40): Acylated with C16 fatty acyl group via epsilon amine

SEQ ID NO: 27 - protein, 40 aa, Artificial Sequence
  Synthetic peptide
  MISC_FEATURE (1)..(40): mt-404
  MOD_RES (2)..(2): Xaa is AIB
YXQGTFTSDYSIYLDKKAAEEFVNWLLAGGPSSGAPPPSK

SEQ ID NO: 28 - protein, 40 aa, Artificial Sequence; identical to SEQ ID NO: 27
  Synthetic peptide
  MISC_FEATURE (1)..(40): mt-405
  misc_feature (2)..(2): Xaa can be any naturally occurring amino acid
  MOD_RES (40)..(40): Acylated with C16 fatty acyl group via epsilon amine

SEQ ID NO: 29 - protein, 39 aa, Artificial Sequence
  Synthetic peptide
  MISC_FEATURE (1)..(39): mt-384
  MOD_RES (2)..(2): Xaa is AIB
  MISC_FEATURE (10)..(10): Acylated with a C16 fatty acyl group via gamma-Glu-gamma-Glu spacer
  MOD_RES (20)..(20): Xaa is AIB
  MOD_RES (39)..(39): C-terminal amidation
YXQGTFTSDKSIYLDKQAAXEFVNWLLAGGPSSGAPPPS

SEQ ID NO: 30 - protein, 39 aa, Artificial Sequence; identical to SEQ ID NO: 29
  Synthetic peptide
  MISC_FEATURE (1)..(39): mt-384'
  MOD_RES (2)..(2): Xaa is AIB
  MISC_FEATURE (10)..(10): Acylated with C16 fatty acyl group via dipeptide spacer comprising two acidic amino acids
  MOD_RES (20)..(20): Xaa is AIB
  MOD_RES (39)..(39): C-terminal amidation

SEQ ID NO: 31 - protein, 39 aa, Artificial Sequence
  Synthetic peptide
  MISC_FEATURE (1)..(39): mt-385
  MOD_RES (2)..(2): Xaa is AIB
  MISC_FEATURE (10)..(10): Acylated with C16 fatty acyl group via gamma-Glu-gamma-Glu spacer
  MOD_RES (20)..(20): Xaa is AIB
  MOD_RES (39)..(39): C-terminal amidation
YXQGTFISDKSIYLDKQAAXEFVNWLLAGGPSSGAPPPS

SEQ ID NO: 32 - protein, 39 aa, Artificial Sequence; identical to SEQ ID NO: 31
  Synthetic peptide
  MISC_FEATURE (1)..(39): mt-385'
  MOD_RES (2)..(2): Xaa is AIB
  MISC_FEATURE (10)..(10): Acylated with C16 fatty acyl group via dipeptide spacer comprising two acid amino acids
  MOD_RES (20)..(20): Xaa is AIB
  MOD_RES (39)..(39): C-terminal amidation

SEQ ID NO: 33 - protein, 39 aa, Artificial Sequence
  Synthetic peptide
  MISC_FEATURE (1)..(39): mt-395
  MOD_RES (2)..(2): Xaa is AIB
  MOD_RES (20)..(20): Xaa is AIB
  MOD_RES (39)..(39): C-terminal amidation
YXEGTFTSDYSIYLDKQAAXEFVNWLLAGGPSSGAPPPS

SEQ ID NO: 34 - protein, 40 aa, Artificial Sequence
  Synthetic peptide
  MISC_FEATURE (1)..(40): mt-396
  MOD_RES (2)..(2): Xaa is AIB
  MOD_RES (20)..(20): Xaa is AIB
  MOD_RES (40)..(40): C-terminal amidation
YXEGTFTSDYSIYLDKQAAXEFVNWLLAGGPSSGAPPPSE

SEQ ID NO: 35 - protein, 40 aa, Artificial Sequence
  Synthetic peptide
  MISC_FEATURE (1)..(40): mt-397
  MOD_RES (2)..(2): Xaa is AIB
  MOD_RES (20)..(20): Xaa is AIB
  MOD_RES (40)..(40): C-terminal amidation
YXEGTFTSDYSIYLDKQAAXEFVNWLLAGGPSSGAPPPSR

SEQ ID NO: 36 - protein, 40 aa, Artificial Sequence
  Synthetic peptide
  MISC_FEATURE (1)..(40): mt-398
  MOD_RES (2)..(2): Xaa is AIB
  MOD_RES (20)..(20): Xaa is AIB
  MOD_RES (40)..(40): D-Lys
  MOD_RES (40)..(40): C-terminal amidation
YXEGTFTSDYSIYLDKQAAXEFVNWLLAGGPSSGAPPPSK

SEQ ID NO: 37 - protein, 40 aa, Artificial Sequence
  Synthetic peptide
  MISC_FEATURE (1)..(40): Exendin-4-like peptide
  MOD_RES (2)..(2): Xaa is AIB
HXEGTFTSDVSSYLEEQAAKEFIAWLVKGGPSSGAPPPSK

SEQ ID NO: 38-100 - skipped (63 entries)

SEQ ID NO: 101 - protein, 29 aa, Homo sapiens
  MISC_FEATURE (1)..(29): Wild type glucagon
HSQGTFTSDYSKYLDSRRAQDFVQWLMNT

SEQ ID NO: 102 - protein, 31 aa, Homo sapiens
  MISC_FEATURE (1)..(31): GLP-1(7-37)
HAEGTFTSDVSSYLEGQAAKEFIAWLVKGRG

SEQ ID NO: 103 - protein, 30 aa, Artificial sequence
  Synthetic polypeptide
  MISC_FEATURE (1)..(30): GLP-1(7-36) amidated
  MISC_FEATURE (30)..(30): C-terminal amidation
HAEGTFTSDVSSYLEGQAAKEFIAWLVKGR

SEQ ID NO: 104 - protein, 42 aa, Homo sapiens; identical to SEQ ID NO: 2
  PEPTIDE (1)..(42): gastric inhibitory polypeptide

SEQ ID NO: 105 - protein, 29 aa, Artificial sequence
  Synthetic polypeptide
  MISC_FEATURE (1)..(29): Analog 61
  MISC_FEATURE (16)..(20): Lactam bridge between residues 16 and 20.
HSQGTFTSDYSKYLDEIHQKEFIAWLMNT

SEQ ID NO: 106 - protein, 29 aa, Artificial sequence
  Synthetic polypeptide
  MISC_FEATURE (1)..(29): Analog 62
  MISC_FEATURE (16)..(20): Lactam bridge between residues 16 and 20.
HSQGTFTSDYSIYLDEIHQKEFIAWLMNT

SEQ ID NO: 107 - protein, 29 aa, Artificial sequence
  Synthetic polypeptide
  MISC_FEATURE (1)..(29): Analog 63
  MISC_FEATURE (12)..(16): Lactam bridge between residues 12 and 16.
HSQGTFTSDYSKYLDEIHQKEFIAWLMNT

SEQ ID NO: 108 - protein, 29 aa, Artificial sequence
  Synthetic polypeptide
  MISC_FEATURE (1)..(29): Analog 66
HSQGTFTSDYSKYLDEIHQKEFIAWLLAQ

SEQ ID NO: 109 - protein, 29 aa, Artificial sequence
  Synthetic polypeptide
  MISC_FEATURE (1)..(29): Analog 68
HSQGTFTSDYSKYLDKIHQEEFIAWLMNT

SEQ ID NO: 110 - protein, 29 aa, Artificial sequence
  Synthetic polypeptide
  MISC_FEATURE (1)..(29): Analog 69
  MISC_FEATURE (16)..(20): Lactam bridge between residues 16 and 20
HSQGTFTSDYSKYLDKIHQEEFIAWLMNT

SEQ ID NO: 111 - protein, 29 aa, Artificial sequence
  Synthetic polypeptide
  MISC_FEATURE (1)..(29): Analog 84
  MISC_FEATURE (16)..(20): Lactam bridge between residues 16 and 20
HSQGTFTSDYSIYLDEIHQKEFICWLLAQ

SEQ ID NO: 112 - protein, 29 aa, Artificial sequence
  Synthetic polypeptide
  MISC_FEATURE (1)..(29): Analog 85
  MISC_FEATURE (16)..(20): Lactam bridge between residues 16 and 20
  MISC_FEATURE (24)..(24): PEG (20kDa) covalently attached to Cysteine
HSQGTFTSDYSIYLDEIHQKEFICWLLAQ

SEQ ID NO: 113 - protein, 29 aa, Artificial sequence
  Synthetic polypeptide
  MISC_FEATURE (1)..(29): Analog 92
HSQGTFTSDYSIYLDEKHQKEFIAWLLAQ

SEQ ID NO: 114 - protein, 29 aa, Artificial sequence
  Synthetic polypeptide
  MISC_FEATURE (1)..(29): Analog 93
  MISC_FEATURE (16)..(20): Lactam bridge between residues 16 and 20
  MISC_FEATURE (17)..(21): Lactam bridge between residues 17 and 21
HSQGTFTSDYSIYLDEKHQKEFIAWLLAQ

SEQ ID NO: 115 - protein, 29 aa, Artificial sequence
  Synthetic polypeptide
  MISC_FEATURE (1)..(29): Analog 95
  MISC_FEATURE (16)..(20): Lactam bridge between residues 16 and 20
HAEGTFISDYSIAMDEIHQKDFVNWLLAQ

SEQ ID NO: 116 - protein, 29 aa, Artificial sequence
  Synthetic polypeptide
  MISC_FEATURE (1)..(29): Analog 96
  MISC_FEATURE (16)..(20): Lactam bridge between residues 16 and 20
YAEGTFISDYSIAMDEIHQKDFVNWLLAQ

SEQ ID NO: 117 - protein, 29 aa, Artificial sequence
  Synthetic polypeptide
  MISC_FEATURE (1)..(29): Analog 97
  MISC_FEATURE (16)..(20): Lactam bridge between residues 16 and 20
HAEGTFTSDYSIYMDEIHQKDFVNWLLAQ

SEQ ID NO: 118 - protein, 29 aa, Artificial sequence
  Synthetic polypeptide
  MISC_FEATURE (1)..(29): Analog 98
  MISC_FEATURE (16)..(20): Lactam bridge between residues 16 and 20
YAEGTFTSDYSIYMDEIHQKDFVNWLLAQ

SEQ ID NO: 119 - protein, 42 aa, Artificial sequence
  Synthetic polypeptide
  MISC_FEATURE (1)..(42): Analog 99
YAEGTFISDYSIAMDKIHQQDFVNWLLAQKGKKNWLKHNITQ

SEQ ID NO: 120 - protein, 42 aa, Artificial sequence
  Synthetic polypeptide
  MISC_FEATURE (1)..(42): Analog 100
  MOD_RES (2)..(2): Xaa is Aib
YXEGTFISDYSIAMDKIHQQDFVNWLLAQKGKKNWLKHNITQ

SEQ ID NO: 121 - protein, 42 aa, Artificial sequence
  Synthetic polypeptide
  MISC_FEATURE (1)..(42): Analog 101
YAPGTFISDYSIAMDKIHQQDFVNWLLAQKGKKNWLKHNITQ

SEQ ID NO: 122 - protein, 42 aa, Artificial sequence
  Synthetic polypeptide
  MISC_FEATURE (1)..(42): Analog 102
  MOD_RES (2)..(2): Xaa is Aib
YXEGTFISDYSIAMDKIHQQDFVCWLLAQKGKKNWLKHNITQ

SEQ ID NO: 123 - protein, 42 aa, Artificial sequence
  Synthetic polypeptide
  MISC_FEATURE (1)..(42): Analog 104
YAPGTFISDYSIAMDKIHQQDFVCWLLAQKGKKNWLKHNITQ

SEQ ID NO: 124 - protein, 42 aa, Artificial sequence; identical to SEQ ID NO: 123
  Synthetic polypeptide
  MISC_FEATURE (1)..(42): Analog 105
  MISC_FEATURE (24)..(24): PEG (40kDa) attached to Cysteine

SEQ ID NO: 125 - protein, 29 aa, Artificial sequence
  Synthetic polypeptide
  MISC_FEATURE (1)..(29): Analog 106
YAEGTFISDYSIAMDKIHQQDFVNWLLAQ

SEQ ID NO: 126 - protein, 29 aa, Artificial sequence
  Synthetic polypeptide
  MISC_FEATURE (1)..(29): Analog 107
  MISC_FEATURE (16)..(20): Lactam bridge between residues 16 and 20
HSQGTFISDYSKYLDEIHQKEFIAWLMNT

SEQ ID NO: 127 - protein, 29 aa, Artificial sequence
  Synthetic polypeptide
  MISC_FEATURE (1)..(29): Analog 108
  MISC_FEATURE (16)..(20): Lactam bridge between residues 16 and 20
HSQGTFISDYSKALDEIHQKEFIAWLMNT

SEQ ID NO: 128 - protein, 29 aa, Artificial sequence
  Synthetic polypeptide
  MISC_FEATURE (1)..(29): Analog 109
  MISC_FEATURE (16)..(20): Lactam bridge between residues 16 and 20
YSQGTFTSDYSKYLDEIHQKDFVNWLLAQ

SEQ ID NO: 129 - protein, 29 aa, Artificial sequence
  Synthetic polypeptide
  MISC_FEATURE (1)..(29): Analog 110
  MISC_FEATURE (16)..(20): Lactam bridge between residues 16 and 20
YSQGTFTSDYSIYLDEIHQKDFVNWLLAQ

SEQ ID NO: 130 - protein, 29 aa, Artificial sequence
  Synthetic polypeptide
  MISC_FEATURE (1)..(29): Analog 111
  MISC_FEATURE (16)..(20): Lactam bridge between residues 16 and 20
HSQGTFTSDYSKYLDEIHQKDFVNWLLAQ

SEQ ID NO: 131 - protein, 24 aa, Artificial sequence
  Synthetic polypeptide
  MISC_FEATURE (1)..(24): Analog 113
  MOD_RES (1)..(1): Xaa is 3-phenyllactic acid
  MISC_FEATURE (11)..(15): Lactam bridge between residues 11 and 15
XISDYSIAMDEIHQKDFVNWLLAQ

SEQ ID NO: 132 - protein, 24 aa, Artificial sequence
  Synthetic polypeptide
  MISC_FEATURE (1)..(24): Analog 114
  MOD_RES (1)..(1): Xaa is 3-phenyllactic acid
  MISC_FEATURE (11)..(15): Lactam bridge between residues 11 and 15
XTSDYSKYLDEIHQKDFVNWLLAQ

SEQ ID NO: 133 - protein, 39 aa, Artificial sequence
  Synthetic polypeptide
  MISC_FEATURE (1)..(39): Analog 115
  MISC_FEATURE (16)..(20): Lactam bridge between residues 16 and 20
HSQGTFTSDYSKYLDEIHQKDFVNWLLAGGPSSGAPPPS

SEQ ID NO: 134 - protein, 39 aa, Artificial sequence
  Synthetic polypeptide
  MISC_FEATURE (1)..(39): Analog 116
  MISC_FEATURE (16)..(20): Lactam bridge between residues 16 and 20
YSQGTFTSDYSKYLDEIHQKDFVNWLLAGGPSSGAPPPS

SEQ ID NO: 135 - protein, 29 aa, Artificial sequence
  Synthetic polypeptide
  MISC_FEATURE (1)..(29): Analog 118
  MISC_FEATURE (16)..(20): Lactam bridge between residues 16 and 20
YSQGTFTSDYSKYLDEIHQKEFVNWLLAQ

SEQ ID NO: 136 - protein, 39 aa, Artificial sequence
  Synthetic polypeptide
  MISC_FEATURE (1)..(39): Analog 120
  MISC_FEATURE (16)..(20): Lactam bridge between residues 16 and 20
YSQGTFTSDYSKYLDEQAAKEFIAWLMNGGPSSGAPPPS

SEQ ID NO: 137 - protein, 29 aa, Artificial sequence
  Synthetic polypeptide
  MISC_FEATURE (1)..(29): Analog 124
  MISC_FEATURE (16)..(20): Lactam bridge between residues 16 and 20
HSQGTFTSDYSIYMDEIHQKDFVNWLLAQ

SEQ ID NO: 138 - protein, 29 aa, Artificial sequence
  Synthetic polypeptide
  MISC_FEATURE (1)..(29): Analog 125
  MISC_FEATURE (16)..(20): Lactam bridge between residues 16 and 20
YSQGTFTSDYSIYMDEIHQKDFVNWLLAQ

SEQ ID NO: 139 - protein, 39 aa, Artificial sequence
  Synthetic polypeptide
  MISC_FEATURE (1)..(39): Analog 127
  MISC_FEATURE (16)..(20): Lactam bridge between residues 16 and 20
YSQGTFTSDYSKYLDEQAAKEFVNWLLAGGPSSGAPPPS

SEQ ID NO: 140 - protein, 39 aa, Artificial sequence
  Synthetic polypeptide
  MISC_FEATURE (1)..(39): Analog 128
  MISC_FEATURE (16)..(20): Lactam bridge between residues 16 and 20
HSQGTFTSDYSKYLDEIHQKDFIAWLMNGGPSSGAPPPS

SEQ ID NO: 141 - protein, 39 aa, Artificial sequence
  Synthetic polypeptide
  MISC_FEATURE (1)..(39): Analog 129
  MISC_FEATURE (16)..(20): Lactam bridge between residues 16 and 20
YSQGTFTSDYSKYLDEIHQKDFIAWLMNGGPSSGAPPPS

SEQ ID NO: 142 - protein, 39 aa, Artificial sequence
  Synthetic polypeptide
  MISC_FEATURE (1)..(39): Analog 139
  MISC_FEATURE (16)..(20): Lactam bridge between residues 16 and 20
YSQGTFTSDYSKYLDEQAAKEFIAWLLAGGPSSGAPPPS

SEQ ID NO: 143 - protein, 39 aa, Artificial sequence
  Synthetic polypeptide
  MISC_FEATURE (1)..(39): Analog 140
  MISC_FEATURE (16)..(20): Lactam bridge between residues 16 and 20
YSQGTFTSDYSIYLDEQAAKEFVNWLLAGGPSSGAPPPS

SEQ ID NO: 144 - protein, 39 aa, Artificial sequence
  Synthetic polypeptide
  MISC_FEATURE (1)..(39): Analog 141
  MISC_FEATURE (16)..(20): Lactam bridge between residues 16 and 20
YSQGTFTSDYSKYMDEQAAKEFVNWLLAGGPSSGAPPPS

SEQ ID NO: 145 - protein, 39 aa, Artificial sequence
  Synthetic polypeptide
  MISC_FEATURE (1)..(39): Analog 142
  MISC_FEATURE (16)..(20): Lactam bridge between residues 16 and 20
YAEGTFTSDYSIYMDEQAAKEFVNWLLAGGPSSGAPPPS

SEQ ID NO: 146 - protein, 39 aa, Artificial sequence
  Synthetic polypeptide
  MISC_FEATURE (1)..(39): Analog 143
  MISC_FEATURE (16)..(20): Lactam bridge between residues 16 and 20
YSQGTFTSDYSKYLDERRAKEFVNWLLAGGPSSGAPPPS

SEQ ID NO: 147 - protein, 39 aa, Artificial sequence
  Synthetic polypeptide
  MISC_FEATURE (1)..(39): Analog 144
  MISC_FEATURE (16)..(20): Lactam bridge between residues 16 and 20
YAQGTFTSDYSIYMDEQAAKEFVNWLLAGGPSSGAPPPS

SEQ ID NO: 148 - protein, 39 aa, Artificial sequence
  Synthetic polypeptide
  MISC_FEATURE (1)..(39): Analog 145
  MISC_FEATURE (16)..(20): Lactam bridge between residues 16 and 20
YAQGTFISDYSKYLDEQAAKEFVNWLLAGGPSSGAPPPS

SEQ ID NO: 149 - protein, 39 aa, Artificial sequence; identical to SEQ ID NO: 148
  Synthetic polypeptide
  MISC_FEATURE (1)..(39): Analog 146
  MISC_FEATURE (16)..(20): Lactam bridge between residues 16 and 20

SEQ ID NO: 150 - protein, 39 aa, Artificial sequence
  Synthetic polypeptide
  MISC_FEATURE (1)..(39): Analog 147
  MISC_FEATURE (16)..(20): Lactam bridge between residues 16 and 20
YSQGTFTSDYSIYLDEQAAKEFIAWLLAGGPSSGAPPPS

SEQ ID NO: 151 - protein, 39 aa, Artificial sequence
  Synthetic polypeptide
  MISC_FEATURE (1)..(39): Analog 148
  MISC_FEATURE (16)..(20): Lactam bridge between residues 16 and 20
YSEGTFTSDYSIYLDEQAAKEFIAWLLAGGPSSGAPPPS

SEQ ID NO: 152 - protein, 39 aa, Artificial sequence
  Synthetic polypeptide
  MISC_FEATURE (1)..(39): Analog 149
  MISC_FEATURE (16)..(20): Lactam bridge between residues 16 and 20
YAEGTFTSDYSIYLDEQAAKEFVNWLLAGGPSSGAPPPS

SEQ ID NO: 153 - protein, 39 aa, Artificial sequence
  Synthetic polypeptide
  MISC_FEATURE (1)..(39): Analog 150
  MISC_FEATURE (16)..(20): Lactam bridge between residues 16 and 20
YSQGTFISDYSIYLDEQAAKEFVNWLLAGGPSSGAPPPS

SEQ ID NO: 154 - protein, 39 aa, Artificial sequence; identical to SEQ ID NO: 142
  Synthetic polypeptide
  MISC_FEATURE (1)..(39): Analog 151
  MISC_FEATURE (16)..(20): Lactam bridge between residues 16 and 20

SEQ ID NO: 155 - protein, 39 aa, Artificial sequence
  Synthetic polypeptide
  MISC_FEATURE (1)..(39): Analog 152
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPS

SEQ ID NO: 156 - protein, 39 aa, Artificial sequence
  Synthetic polypeptide
  MISC_FEATURE (1)..(39): Analog 154
  MOD_RES (1)..(1): Xaa is hippuric acid
  MISC_FEATURE (16)..(20): Lactam bridge between residues 16 and 20
XSQGTFTSDYSIYLDEQAAKEFVNWLLAGGPSSGAPPPS

SEQ ID NO: 157 - protein, 39 aa, Artificial sequence; identical to SEQ ID NO: 139
  Synthetic polypeptide
  MISC_FEATURE (1)..(39): Analog 155
  MISC_FEATURE (12)..(16): Lactam bridge between residues 12 and 16

SEQ ID NO: 158 - protein, 39 aa, Artificial sequence
  Synthetic polypeptide
  MISC_FEATURE (1)..(39): Analog 156
  MISC_FEATURE (20)..(24): Lactam bridge between residues 20 and 24
YSQGTFTSDYSIYLDEQAAKEFVEWLLAGGPSSGAPPPS

SEQ ID NO: 159 - protein, 39 aa, Artificial sequence
  Synthetic polypeptide
  MISC_FEATURE (1)..(39): Analog 157
  MISC_FEATURE (24)..(28): Lactam bridge between residues 24 and 28
YSQGTFTSDYSIYLDEQAAKEFVEWLLKGGPSSGAPPPS

SEQ ID NO: 160 - protein, 39 aa, Artificial sequence
  Synthetic polypeptide
  MISC_FEATURE (1)..(39): Analog 158
  MOD_RES (2)..(2): Xaa is Aib
  MISC_FEATURE (16)..(20): Lactam bridge between residues 16 and 20
YXQGTFTSDYSIYLDEQAAKEFVCWLLAGGPSSGAPPPS

SEQ ID NO: 161 - protein, 39 aa, Artificial sequence
  Synthetic polypeptide
  MISC_FEATURE (1)..(39): Analog 162
  MOD_RES (2)..(2): Xaa is Aib
  MISC_FEATURE (16)..(20): Lactam bridge between residues 16 and 20
YXQGTFTSDYSYYLDEQAVKEFVNWLIAGGPSSGAPPPS

SEQ ID NO: 162 - protein, 29 aa, Artificial sequence
  Synthetic polypeptide
  MISC_FEATURE (1)..(29): Analog 163
  MISC_FEATURE (16)..(20): Lactam bridge between residues 16 and 20
YSQGTFTSDYSIYLDEQAAKEFVNWLLAG

SEQ ID NO: 163 - protein, 29 aa, Artificial sequence
  Synthetic polypeptide
  MISC_FEATURE (1)..(29): Analog 164
  MOD_RES (2)..(2): Xaa is Aib
  MISC_FEATURE (16)..(20): Lactam bridge between residues 16 and 20
YXQGTFTSDYSIYLDEQAAKEFVNWLLAG

SEQ ID NO: 164 - protein, 40 aa, Artificial sequence
  Synthetic polypeptide
  MISC_FEATURE (1)..(40): Analog 165
  MOD_RES (2)..(2): Xaa is Aib
  MISC_FEATURE (16)..(20): Lactam bridge between residues 16 and 20
YXQGTFTSDYSIYLDEQAAKEFVNWLLAGGPSSGAPPPSC

SEQ ID NO: 165 - protein, 40 aa, Artificial sequence; identical to SEQ ID NO: 164
  Synthetic polypeptide
  MISC_FEATURE (1)..(40): Analog 166
  MOD_RES (2)..(2): Xaa is d-alanine
  MISC_FEATURE (16)..(20): Lactam bridge between residues 16 and 20

SEQ ID NO: 166 - protein, 39 aa, Artificial sequence
  Synthetic polypeptide
  MISC_FEATURE (1)..(39): Analog 167
  MISC_FEATURE (17)..(20): Lactam bridge between residues 17 and 20
YSQGTFTSDYSIYLDEEAAKEFVNWLLAGGPSSGAPPPS

SEQ ID NO: 167 - protein, 39 aa, Artificial sequence
  Synthetic polypeptide
  MISC_FEATURE (1)..(39): Analog 168
  MISC_FEATURE (18)..(21): Lactam bridge between residues 18 and 21
YSQGTFTSDYSIYLDEQKAKEFVNWLLAGGPSSGAPPPS

SEQ ID NO: 168 - protein, 29 aa, Artificial sequence
  Synthetic polypeptide
  MISC_FEATURE (1)..(29): Analog 169
  MOD_RES (2)..(2): Xaa is Aib
  MISC_FEATURE (16)..(20): Lactam bridge between residues 16 and 20
YXQGTFTSDYSIYLDEQAAKEFVCWLLAG

SEQ ID NO: 169 - protein, 40 aa, Artificial sequence; identical to SEQ ID NO: 164
  Synthetic polypeptide
  MISC_FEATURE (1)..(40): Analog 170
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 170 - protein, 29 aa, Artificial sequence
  Synthetic polypeptide
  MISC_FEATURE (1)..(29): Analog 172
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLLAG

SEQ ID NO: 171 - protein, 40 aa, Artificial sequence
  Synthetic polypeptide
  MISC_FEATURE (1)..(40): Analog 174
  MOD_RES (2)..(2): Xaa is Aib
  MISC_FEATURE (16)..(20): Lactam bridge between residues 16 and 20
YXEGTFTSDYSIYLDEQAAKEFVNWLLAGGPSSGAPPPSC

SEQ ID NO: 172 - protein, 39 aa, Artificial sequence; identical to SEQ ID NO: 160
  Synthetic polypeptide
  MISC_FEATURE (1)..(39): Analog 175
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine

SEQ ID NO: 173 - protein, 40 aa, Artificial sequence
  Synthetic polypeptide
  MISC_FEATURE (1)..(40): Analog 176
  MOD_RES (2)..(2): Xaa is Aib
  MISC_FEATURE (16)..(20): Lactam bridge between residues 16 and 20
YXQGTFISDYSIYLDEQAAKEFVNWLLAGGPSSGAPPPSC

SEQ ID NO: 174 - protein, 29 aa, Artificial sequence
  Synthetic polypeptide
  MISC_FEATURE (1)..(29): Analog 177
  MOD_RES (2)..(2): Xaa is Aib
  MISC_FEATURE (16)..(20): Lactam bridge between residues 16 and 20
YXQGTFISDYSIYLDEQAAKEFVCWLLAG

SEQ ID NO: 175 - protein, 40 aa, Artificial sequence; identical to SEQ ID NO: 171
  Synthetic polypeptide
  MISC_FEATURE (1)..(40): Analog 178
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 176 - protein, 29 aa, Artificial sequence
  Synthetic polypeptide
  MISC_FEATURE (1)..(29): Analog 179
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFISDYSIYLDEQAAKEFVCWLLAG

SEQ ID NO: 177 - protein, 40 aa, Artificial sequence; identical to SEQ ID NO: 173
  Synthetic polypeptide
  MISC_FEATURE (1)..(40): Analog 182
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 178 - protein, 29 aa, Artificial sequence
  Synthetic polypeptide
  MISC_FEATURE (1)..(29): Analog 186
  MOD_RES (2)..(2): Xaa is Aib
  MISC_FEATURE (16)..(20): Lactam bridge between residues 16 and 20
  MISC_FEATURE (24)..(24): PEG (40kDa) covalently attached to Cysteine
YXQGTFTSDYSIYLDEQAAKEFVCWLMNG

SEQ ID NO: 179 - protein, 39 aa, Artificial sequence; identical to SEQ ID NO: 155
  Synthetic polypeptide
  MISC_FEATURE (1)..(39): Analog 191
  MOD_RES (2)..(2): Xaa is Aib

SEQ ID NO: 180 - protein, 34 aa, Artificial sequence
  Synthetic polypeptide
  MISC_FEATURE (1)..(34): Analog 192
FTSDYSIYLDEQAAKEFVNWLLAGGPSSGAPPPS

SEQ ID NO: 181 - protein, 38 aa, Artificial sequence
  Synthetic polypeptide
  MISC_FEATURE (1)..(38): Analog 194
  MOD_RES (1)..(1): Xaa is Aib
XQGTFTSDYSIYLDEEAVRLFVNWLLAGGPSSGAPPPS

SEQ ID NO: 182 - protein, 26 aa, Artificial sequence
  Synthetic polypeptide
  MISC_FEATURE (1)..(26): Analog 197
  MISC_FEATURE (13)..(17): Lactam bridge between residues 13 and 17
GTFTSDYSIYLDEQAAKEFVNWLLAG

SEQ ID NO: 183 - protein, 28 aa, Artificial sequence
  Synthetic polypeptide
  MISC_FEATURE (1)..(28): Analog 198
  MOD_RES (1)..(1): Xaa is Aib
  MISC_FEATURE (15)..(19): Lactam bridge between residues 15 and 19
XQGTFTSDYSIYLDEQAAKEFVNWLLAG

SEQ ID NO: 184 - protein, 40 aa, Artificial sequence
  Synthetic polypeptide
  MISC_FEATURE (1)..(40): Analog 199
  MOD_RES (2)..(2): Xaa is Aib
  MISC_FEATURE (16)..(20): Lactam bridge between residues 16 and 20
YXQGTFVSDYSIYLDEQAAKEFVNWLLAGGPSSGAPPPSC

SEQ ID NO: 185 - protein, 40 aa, Artificial sequence
  Synthetic polypeptide
  MISC_FEATURE (1)..(40): Analog 200
  MOD_RES (2)..(2): Xaa is Aib
  MISC_FEATURE (16)..(20): Lactam bridge between residues 16 and 20
  MOD_RES (27)..(27): Xaa is Nle
YXQGTFTSDYSIYLDEQAAKEFVNWLXAGGPSSGAPPPSC

SEQ ID NO: 186 - protein, 39 aa, Artificial sequence
  Synthetic polypeptide
  MISC_FEATURE (1)..(39): Analog 201
  MOD_RES (2)..(2): Xaa is Aib
YXQGTFTSDYSIYLDEEAVRLFVNWLLAGGPSSGAPPPS

SEQ ID NO: 187 - protein, 40 aa, Artificial sequence; identical to SEQ ID NO: 184
  Synthetic polypeptide
  MISC_FEATURE (1)..(40): Analog 202
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 188 - protein, 40 aa, Artificial sequence; identical to SEQ ID NO: 185
  Synthetic polypeptide
  MISC_FEATURE (1)..(40): Analog 203
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): PEG (40kDa) covalently attached to Cysteine

SEQ ID NO: 189 - protein, 40 aa, Artificial sequence
  Synthetic polypeptide
  MISC_FEATURE (1)..(40): Analog 204
  MOD_RES (2)..(2): Xaa is Aib
  MISC_FEATURE (16)..(20): Lactam bridge between residues 16 and 20
YXEGTFTSDYSIYLDEQAAKEFVNWLLAGRPSSGAPPPSC

SEQ ID NO: 190 - protein, 40 aa, Artificial sequence; identical to SEQ ID NO: 189
  Synthetic polypeptide
  MISC_FEATURE (1)..(40): Analog 205
  MOD_RES (2)..(2): Xaa is Aib
  MISC_FEATURE (16)..(20): Lactam bridge between residues 16 and 20
  MISC_FEATURE (40)..(40): PEG (40kDa) covalently attached to Cysteine

SEQ ID NO: 191 - protein, 43 aa, Artificial sequence
  Synthetic polypeptide
  MISC_FEATURE (1)..(43): Analog 206
  MOD_RES (2)..(2): Xaa is Aib
  MISC_FEATURE (16)..(20): Lactam bridge between residues 16 and 20
YXEGTFTSDYSIYLDEQAAKEFVNWLLAGKGKKNWLKHNITQC

SEQ ID NO: 192 - protein, 43 aa, Artificial sequence
  Synthetic polypeptide
  MISC_FEATURE (1)..(43): Analog 207
  MOD_RES (2)..(2): Xaa is Aib
  MISC_FEATURE (16)..(20): Lactam bridge between residues 16 and 20
YXQGTFTSDYSIYLDEQAAKEFVNWLLAGKGKKNWLKHNITQC

SEQ ID NO: 193 - protein, 43 aa, Artificial sequence; identical to SEQ ID NO: 191
  Synthetic polypeptide
  MISC_FEATURE (1)..(43): Analog 208
  MOD_RES (2)..(2): Xaa is Aib
  MISC_FEATURE (16)..(20): Lactam bridge between residues 16 and 20
  MISC_FEATURE (43)..(43): PEG (40kDa) covalently attached to Cysteine

SEQ ID NO: 194 - protein, 40 aa, Artificial sequence
  Synthetic polypeptide
  MISC_FEATURE (1)..(40): Analog 209
  MOD_RES (2)..(2): Xaa is Aib
  MISC_FEATURE (9)..(12): Lactam bridge between residues 9 and 12
  MISC_FEATURE (16)..(20): Lactam bridge between residues 16 and 20
YXQGTFTSEYSKYLDEQAAKEFVNWLLAGGPSSGAPPPSC

SEQ ID NO: 195 - protein, 10 aa, Artificial sequence
  Synthetic polypeptide
  MISC_FEATURE (1)..(10): CEX
GPSSGAPPPS

SEQ ID NO: 196 - protein, 11 aa, Artificial sequence
  Synthetic polypeptide
  MISC_FEATURE (1)..(1): Xaa is any amino acid
XGPSSGAPPPS

SEQ ID NO: 197 - protein, 8 aa, Artificial sequence
  Synthetic polypeptide
KRNRNNIA

SEQ ID NO: 198 - protein, 4 aa, Artificial sequence
  Synthetic polypeptide
KRNR

SEQ ID NO: 199 - protein, 40 aa, Artificial Sequence
  Synthetic polypeptide
  MISC_FEATURE (1)..(40): mt-274
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation
YXEGTFTSDYSIYLDKQAAXEFVNWLLAGGPSSGAPPPSC

SEQ ID NO: 200 - protein, 40 aa, Artificial Sequence
  Synthetic polypeptide
  MISC_FEATURE (1)..(40): mt-311
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation
YXEGTFTSDYSIYLDKQAAXEFVCWLLAGGPSSGAPPPSK

SEQ ID NO: 201 - protein, 40 aa, Artificial Sequence; identical to SEQ ID NO: 200
  Synthetic polypeptide
  MISC_FEATURE (1)..(40): mt-298
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 202 - protein, 40 aa, Artificial Sequence; identical to SEQ ID NO: 200
  Synthetic polypeptide
  MISC_FEATURE (1)..(40): mt-309
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached Lysine
  MISC_FEATURE (40)..(40): C-terminal amidation

SEQ ID NO: 203 - protein, 40 aa, Artificial Sequence; identical to SEQ ID NO: 200
  Synthetic polypeptide
  MISC_FEATURE (1)..(40): mt-310
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 204 - protein, 40 aa, Artificial Sequence; identical to SEQ ID NO: 36
  Synthetic polypeptide
  MISC_FEATURE (1)..(40): mt-260
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 205 - protein, 40 aa, Artificial Sequence; identical to SEQ ID NO: 36
  Synthetic polypeptide
  MISC_FEATURE (1)..(40): mt-261
  MOD_RES (2)..(2): Xaa is Aib
  MOD_RES (20)..(20): Xaa is Aib
  MISC_FEATURE (40)..(40): 16 Carbon fatty acyl group covalently attached Lysine
  MISC_FEATURE (40)..(40): C-terminal amidation

SEQ ID NO: 206 - protein, 40 aa, Artificial Sequence; identical to SEQ ID NO: 36
  Synthetic polypeptide
  MISC_FEATURE (1)..(40): mt-262
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 207 - protein, 40 aa, Artificial Sequence
  Synthetic polypeptide
  MISC_FEATURE (1)..(40): mt-252
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLLAGGPSSGAPPPSC

SEQ ID NO: 208 - protein, 40 aa, Artificial Sequence; identical to SEQ ID NO: 207
  Synthetic polypeptide
  MISC_FEATURE (1)..(40): mt-255
  MOD_RES (2)..(2): Xaa is Aib
  MOD_RES (20)..(20): Xaa is Aib
  MISC_FEATURE (40)..(40): PEG (40kDa) attached to Cysteine
  MISC_FEATURE (40)..(40): C-terminal amidation

SEQ ID NO: 209 - protein, 40 aa, Artificial Sequence; identical to SEQ ID NO: 199
  Synthetic polypeptide
  MISC_FEATURE (1)..(40): mt-256
  MOD_RES (2)..(2): Xaa is Aib
  MOD_RES (20)..(20): Xaa is Aib
  MISC_FEATURE (40)..(40): C-terminal amidation

SEQ ID NO: 210 - protein, 29 aa, Artificial Sequence
  Synthetic polypeptide
  MISC_FEATURE (1)..(29): mt-257
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVCWLLAG

SEQ ID NO: 211 - protein, 40 aa, Artificial Sequence; identical to SEQ ID NO: 36
  Synthetic polypeptide
  MISC_FEATURE (1)..(40): mt-263
  MOD_RES (2)..(2): Xaa is Aib
  MOD_RES (20)..(20): Xaa is Aib
  MISC_FEATURE (40)..(40): C-terminal amidation

SEQ ID NO: 212 - protein, 29 aa, Artificial Sequence
  Synthetic polypeptide
  MISC_FEATURE (1)..(29): mt-264
  MISC_FEATURE (2)..(2): Xaa is Aib
  MISC_FEATURE (20)..(20): Xaa is Aib
YXQGTFTSDYSIYLDKQAAXEFVNWLLAG

SEQ ID NO: 213 - protein, 39 aa, Artificial Sequence
  Synthetic polypeptide
  MISC_FEATURE (1)..(39): mt-265
  MOD_RES (2)..(2): Xaa is Aib
  MOD_RES (20)..(20): Xaa is Aib
  MISC_FEATURE (24)..(24): 14 Carbon fatty acyl group covalently attached to Lysine
  MISC_FEATURE (39)..(39): C-terminal amidation
YXEGTFTSDYSIYLDKQAAXEFVKWLLAGGPSSGAPPPS

SEQ ID NO: 214 - protein, 39 aa, Artificial Sequence; identical to SEQ ID NO: 213
  Synthetic polypeptide
  MISC_FEATURE (1)..(39): mt-266
  MOD_RES (2)..(2): Xaa is Aib
  MOD_RES (20)..(20): Xaa is Aib
  MISC_FEATURE (24)..(24): 16 Carbon fatty acyl group covalently attached to Lysine
  MISC_FEATURE (39)..(39): C-terminal amidation

SEQ ID NO: 215 - protein, 39 aa, Artificial Sequence; identical to SEQ ID NO: 213
  Synthetic polypeptide
  MISC_FEATURE (1)..(39): mt-267
  MOD_RES (2)..(2): Xaa is Aib
  MOD_RES (20)..(20): Xaa is Aib
  MISC_FEATURE (24)..(24): 18 Carbon fatty acyl group covalently attached to Lysine
  MISC_FEATURE (39)..(39): C-terminal amidation

SEQ ID NO: 216 - protein, 39 aa, Artificial Sequence; identical to SEQ ID NO: 213
  Synthetic polypeptide
  MISC_FEATURE (1)..(39): mt-268
  MOD_RES (2)..(2): Xaa is Aib
  MOD_RES (20)..(20): Xaa is Aib
  MISC_FEATURE (39)..(39): C-terminal amidation

SEQ ID NO: 217 - protein, 39 aa, Artificial Sequence
  Synthetic polypeptide
  MISC_FEATURE (1)..(39): mt-269
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (39)..(39): C-terminal amidation
YXEGTFTSDKSIYLDKQAAXEFVNWLLAGGPSSGAPPPS

SEQ ID NO: 218 - protein, 39 aa, Artificial Sequence; identical to SEQ ID NO: 217
  Synthetic polypeptide
  MISC_FEATURE (1)..(39): mt-270
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (39)..(39): C-terminal amidation

SEQ ID NO: 219 - protein, 39 aa, Artificial Sequence; identical to SEQ ID NO: 217
  Synthetic polypeptide
  MISC_FEATURE (1)..(39): mt-271
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (39)..(39): C-terminal amidation

SEQ ID NO: 220 - protein, 39 aa, Artificial Sequence; identical to SEQ ID NO: 217
  Synthetic polypeptide
  MISC_FEATURE (1)..(39): mt-272
  MOD_RES (2)..(2): Xaa is Aib
  MOD_RES (20)..(20): Xaa is Aib
  MISC_FEATURE (39)..(39): C-terminal amidation

SEQ ID NO: 221 - protein, 40 aa, Artificial Sequence
  Synthetic polypeptide
  MISC_FEATURE (1)..(40): mt-275
  MOD_RES (2)..(2): Xaa is Aib
  MOD_RES (16)..(16): Xaa is Orn
  MOD_RES (20)..(20): Xaa is Aib
  MISC_FEATURE (40)..(40): C-terminal amidation
YXQGTFTSDYSIYLDXQAAXEFVNWLLAGGPSSGAPPPSC

SEQ ID NO: 222 - protein, 40 aa, Artificial Sequence; identical to SEQ ID NO: 221
  Synthetic polypeptide
  MISC_FEATURE (1)..(40): mt-276
  MOD_RES (2)..(2): Xaa is Aib
  MOD_RES (16)..(16): Xaa is 2,4-diaminobutyric acid
  MOD_RES (20)..(20): Xaa is Aib
  MISC_FEATURE (40)..(40): C-terminal amidation

SEQ ID NO: 223 - protein, 40 aa, Artificial Sequence
  Synthetic polypeptide
  MISC_FEATURE (1)..(40): mt-277
  MOD_RES (2)..(2): Xaa is Aib
  MOD_RES (20)..(20): Xaa is Aib
  MISC_FEATURE (40)..(40): 14 Carbon fatty acyl group covalentaly attached to Lysine
  MISC_FEATURE (40)..(40): C-terminal amidation
YXQGTFTSDYSIYLDKQAAXEFVNWLLAGGPSSGAPPPSK

SEQ ID NO: 224 - protein, 40 aa, Artificial Sequence; identical to SEQ ID NO: 223
  Synthetic polypeptide
  MISC_FEATURE (1)..(40): mt-278
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 225 - protein, 40 aa, Artificial Sequence; identical to SEQ ID NO: 223
  Synthetic polypeptide
  MISC_FEATURE (1)..(40): mt-279
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 226 - protein, 40 aa, Artificial Sequence; identical to SEQ ID NO: 223
  Synthetic polypeptide
  MISC_FEATURE (1)..(40): mt-280
  MOD_RES (2)..(2): Xaa is Aib
  MOD_RES (20)..(20): Xaa is Aib
  MISC_FEATURE (40)..(40): C-terminal amidation

SEQ ID NO: 227 - protein, 29 aa, Artificial Sequence
  Synthetic polypeptide
  MISC_FEATURE (1)..(29): mt-281
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (29)..(29): C-terminal amidation
YXQGTFTSDYSIYLDKQAAXEFVCWLLAG

SEQ ID NO: 228 - protein, 29 aa, Artificial Sequence
  Synthetic polypeptide
  MISC_FEATURE (1)..(29): mt-282
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 229 - protein, 29 aa, Artificial Sequence
  Synthetic polypeptide
  MISC_FEATURE (1)..(29): mt-283
  MOD_RES (2)..(2): Xaa is Aib
  MISC_FEATURE (10)..(10): 16 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 230 - protein, 29 aa, Artificial Sequence
  Synthetic polypeptide
  MISC_FEATURE (1)..(29): mt-284
  MOD_RES (2)..(2): Xaa is Aib
  MISC_FEATURE (10)..(10): 18 Carbon fatty acyl group covalently attached to Lysine
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 231 - protein, 29 aa, Artificial Sequence
  Synthetic polypeptide
  MISC_FEATURE (1)..(29): mt-285
  MOD_RES (2)..(2): Xaa is Aib
  MOD_RES (20)..(20): Xaa is Aib
  MISC_FEATURE (29)..(29): C-terminal amidation
YXEGTFTSDKSIYLDKQAAXEFVNWLLAG

SEQ ID NO: 232 - protein, 40 aa, Artificial Sequence
  Synthetic polypeptide
  MISC_FEATURE (1)..(40): mt-286
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation
YXQGTFTSDYSIYLDKQAAXEFVCWLLAGGPSSGAPPPSK

SEQ ID NO: 233 - protein, 40 aa, Artificial Sequence; identical to SEQ ID NO: 232
  Synthetic polypeptide
  MISC_FEATURE (1)..(40): mt-287
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 234 - protein, 40 aa, Artificial Sequence; identical to SEQ ID NO: 232
  Synthetic polypeptide
  MISC_FEATURE (1)..(40): mt-288
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 235 - protein, 40 aa, Artificial Sequence; identical to SEQ ID NO: 232
  Synthetic polypeptide
  MISC_FEATURE (1)..(40): mt-289
  MOD_RES (2)..(2): Xaa is Aib
  MOD_RES (20)..(20): Xaa is Aib
  MISC_FEATURE (40)..(40): C-terminal amidation

SEQ ID NO: 236 - protein, 40 aa, Artificial Sequence; identical to SEQ ID NO: 232
  Synthetic polypeptide
  MISC_FEATURE (1)..(40): mt-290
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 237 - protein, 40 aa, Artificial Sequence; identical to SEQ ID NO: 232
  Synthetic polypeptide
  MISC_FEATURE (1)..(40): mt-291
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 238 - protein, 40 aa, Artificial Sequence; identical to SEQ ID NO: 232
  Synthetic polypeptide
  MISC_FEATURE (1)..(40): mt-292
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 18 Carbon fatty acyl group covalently attached to Lysine
  MISC_FEATURE (40)..(40): C-terminal amidation

SEQ ID NO: 239 - protein, 40 aa, Artificial Sequence; identical to SEQ ID NO: 232
  Synthetic polypeptide
  MISC_FEATURE (1)..(40): mt-293
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 240 - protein, 40 aa, Artificial Sequence; identical to SEQ ID NO: 199
  Synthetic polypeptide
  MISC_FEATURE (1)..(40): mt-295
  MOD_RES (2)..(2): Xaa is Aib
  MOD_RES (20)..(20): Xaa is Aib
  MISC_FEATURE (40)..(40): PEG (40kDa) covalently attached to Cysteine
  MISC_FEATURE (40)..(40): C-terminal amidation

SEQ ID NO: 241 - protein, 40 aa, Artificial Sequence; identical to SEQ ID NO: 200
  Synthetic polypeptide
  MISC_FEATURE (1)..(40): mt-296
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation

SEQ ID NO: 242 - protein, 40 aa, Artificial Sequence
  Synthetic polypeptide
  MISC_FEATURE (1)..(40): mt-297
  MOD_RES (2)..(2): Xaa is Aib
  MOD_RES (20)..(20): Xaa is Aib
  MISC_FEATURE (40)..(40): 16 Carbon fatty acyl group covalently attached to Lysine
  MISC_FEATURE (40)..(40): C-terminal amidation
YXQGTFTSDYSIYLDKQAAXEFVCWLMNGGPSSGAPPPSK

SEQ ID NO: 243 - protein, 40 aa, Artificial Sequence; identical to SEQ ID NO: 242
  Synthetic polypeptide
  MISC_FEATURE (1)..(40): mt-299
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 16 Carbon fatty acyl group covalently attached to Lysine
  MISC_FEATURE (40)..(40): C-terminal amidation

SEQ ID NO: 244 - protein, 40 aa, Artificial Sequence; identical to SEQ ID NO: 200
  Synthetic polypeptide
  MISC_FEATURE (1)..(40): mt-306
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (40)..(40): C-terminal amidation

SEQ ID NO: 245 - protein, 40 aa, Artificial Sequence; identical to SEQ ID NO: 200
  Synthetic polypeptide
  MISC_FEATURE (1)..(40): mt-307
  MOD_RES (2)..(2): Xaa is Aib
  MOD_RES (20)..(20): Xaa is Aib
  MISC_FEATURE (40)..(40): 18 Carbon fatty acyl group covalently attached to Lysine
  MISC_FEATURE (40)..(40): C-terminal amidation

SEQ ID NO: 246 - protein, 40 aa, Artificial Sequence; identical to SEQ ID NO: 200
  Synthetic polypeptide
  MISC_FEATURE (1)..(40): mt-308
  MOD_RES (2)..(2): Xaa is Aib
  MOD_RES (20)..(20): Xaa is Aib
  MISC_FEATURE (40)..(40): C-terminal amidation

SEQ ID NO: 247 - protein, 40 aa, Artificial Sequence; identical to SEQ ID NO: 36
  Synthetic polypeptide
  MISC_FEATURE (1)..(40): mt-322
  MOD_RES (2)..(2): Xaa is Aib
  MOD_RES (20)..(20): Xaa is Aib
  MISC_FEATURE (40)..(40): 3-SH-propionic acyl group covalently attached to Lysine
  MISC_FEATURE (40)..(40): C-terminal amidation

SEQ ID NO: 248 - protein, 40 aa, Artificial Sequence; identical to SEQ ID NO: 223
  Synthetic polypeptide
  MISC_FEATURE (1)..(40): mt-323
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 249 - protein, 40 aa, Artificial Sequence
  Synthetic polypeptide
  MISC_FEATURE (1)..(40): mt-324
  MOD_RES (2)..(2): Xaa is Aib
  MOD_RES (20)..(20): Xaa is Aib
  MISC_FEATURE (40)..(40): C-terminal amidation
YXQGTFSSDYSIYLDKQAAXEFVNWLLAGGPSSGAPPPSC

SEQ ID NO: 250 - protein, 40 aa, Artificial Sequence
  Synthetic polypeptide
  MISC_FEATURE (1)..(40): mt-325
  MOD_RES (2)..(2): Xaa is Aib
  MOD_RES (7)..(7): Xaa is 2-aminobutyric acid
  MOD_RES (20)..(20): Xaa is Aib
  MISC_FEATURE (40)..(40): C-terminal amidation
YXQGTFXSDYSIYLDKQAAXEFVNWLLAGGPSSGAPPPSC

SEQ ID NO: 251 - protein, 40 aa, Artificial Sequence; identical to SEQ ID NO: 232
  Synthetic polypeptide
  MISC_FEATURE (1)..(40): mt-329
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 252 - protein, 40 aa, Artificial Sequence; identical to SEQ ID NO: 200
  Synthetic polypeptide
  MISC_FEATURE (1)..(40): mt-330
  MOD_RES (2)..(2): Xaa is Aib
  MOD_RES (20)..(20): Xaa is Aib
  MISC_FEATURE (40)..(40): 8 Carbon fatty acyl group covalently attached to Lysine
  MISC_FEATURE (40)..(40): C-terminal amidation

SEQ ID NO: 253 - protein, 40 aa, Artificial Sequence; identical to SEQ ID NO: 200
  Synthetic polypeptide
  MISC_FEATURE (1)..(40): mt-331
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): C-terminal amidation

SEQ ID NO: 254 - protein, 40 aa, Artificial Sequence
  Synthetic polypeptide
  MISC_FEATURE (1)..(40): mt-333
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): 14 Carbon fatty acyl group covalently attached to d-Lysine
  MISC_FEATURE (40)..(40): C-terminal amidation
YXEGTFTSDYSIYLDKQAAXEFVCWLLAGGPSSGAPPPSX

SEQ ID NO: 255 - protein, 40 aa, Artificial Sequence; identical to SEQ ID NO: 254
  Synthetic polypeptide
  MISC_FEATURE (1)..(40): mt-334
  MOD_RES (2)..(2): Xaa is Aib
  MOD_RES (20)..(20): Xaa is Aib
  MOD_RES (40)..(40): Xaa is d-Lysine
  MISC_FEATURE (40)..(40): C-terminal amidation

SEQ ID NO: 256 - protein, 40 aa, Artificial Sequence; identical to SEQ ID NO: 254
  Synthetic polypeptide
  MISC_FEATURE (1)..(40): mt-335
  MOD_RES (2)..(2): Xaa is Aib
  MOD_RES (20)..(20): Xaa is Aib
  MISC_FEATURE (24)..(24): PEG (40kDa) covalently attached to Cysteine
  MOD_RES (40)..(40): Xaa is d-Lysine
  MISC_FEATURE (40)..(40): 14 Carbon fatty acyl group covalently attached to Lysine
  MISC_FEATURE (40)..(40): C-terminal amidation

SEQ ID NO: 257 - protein, 40 aa, Artificial Sequence; identical to SEQ ID NO: 254
  Synthetic polypeptide
  MISC_FEATURE (1)..(40): mt-336
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): Xaa is d-Lysine
  MISC_FEATURE (40)..(40): C-terminal amidation

SEQ ID NO: 258 - protein, 39 aa, Artificial Sequence
  Synthetic polypeptide
  MISC_FEATURE (1)..(39): mt-337
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (39)..(39): C-terminal amidation
YXEGTFTSDKSIYLDKQAAXEFVCWLLAGGPSSGAPPPS

SEQ ID NO: 259 - protein, 39 aa, Artificial Sequence; identical to SEQ ID NO: 258
  Synthetic polypeptide
  MISC_FEATURE (1)..(39): mt-338
  MOD_RES (2)..(2): Xaa is Aib
  MOD_RES (20)..(20): Xaa is Aib
  MISC_FEATURE (39)..(39): C-terminal amidation

SEQ ID NO: 260 - protein, 41 aa, Artificial Sequence
  Synthetic polypeptide
  MISC_FEATURE (1)..(41): mt-339
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): C-terminal amidation
YXEGTFTSDYSIYLDKQAAXEFVNWLLAGGPSSGAPPPSKC

SEQ ID NO: 261 - protein, 41 aa, Artificial Sequence; identical to SEQ ID NO: 260
  Synthetic polypeptide
  MISC_FEATURE (1)..(41): mt-340
  MOD_RES (2)..(2): Xaa is Aib
  MOD_RES (20)..(20): Xaa is Aib
  MISC_FEATURE (41)..(41): C-terminal amidation

SEQ ID NO: 262 - protein, 39 aa, Artificial Sequence; identical to SEQ ID NO: 258
  Synthetic polypeptide
  MISC_FEATURE (1)..(39): mt-341
  MOD_RES (2)..(2): Xaa is Aib
  MISC_FEATURE (10)..(10): 14 Carbon fatty acyl group covalently attached to Lysine
  MOD_RES (20)..(20): Xaa is Aib
  MISC_FEATURE (24)..(24): PEG (40kDa) covalently attached to Cysteine
  MISC_FEATURE (39)..(39): C-terminal amidation

SEQ ID NO: 263 - protein, 41 aa, Artificial Sequence; identical to SEQ ID NO: 260
  Synthetic polypeptide
  MISC_FEATURE (1)..(41): mt-343
  MOD_RES (2)..(2): Xaa is Aib
  MOD_RES (20)..(20): Xaa is Aib
  MISC_FEATURE (40)..(40): 14 Carbon fatty acyl group covalently attached to Lysine
  MISC_FEATURE (41)..(41): PEG (40kDa) covalently attached to Cysteine
  MISC_FEATURE (41)..(41): C-terminal amidation

SEQ ID NO: 264 - protein, 41 aa, Artificial Sequence; identical to SEQ ID NO: 260
  Synthetic polypeptide
  MISC_FEATURE (1)..(41): mt-344
  MOD_RES (2)..(2): Xaa is Aib
  MOD_RES (20)..(20): Xaa is Aib
  MISC_FEATURE (41)..(41): PEG (40kDa) covalently attached to Cysteine
  MISC_FEATURE (41)..(41): C-terminal amidation

SEQ ID NO: 265 - protein, 40 aa, Artificial Sequence
  Synthetic polypeptide
  MISC_FEATURE (1)..(40): mt-345
  MOD_RES (2)..(2): Xaa is Aib
  MISC_FEATURE (40)..(40): 14 Carbon fatty acyl group covalently attached to Lysine
  MISC_FEATURE (40)..(40): C-terminal amidation
HXQGTFTSDYSKYLDEQAAKEFICWLMNGGPSSGAPPPSK

SEQ ID NO: 266 - protein, 40 aa, Artificial Sequence; identical to SEQ ID NO: 200
  Synthetic polypeptide
  MISC_FEATURE (1)..(40): mt-353
  MOD_RES (2)..(2): Xaa is Aib
  MOD_RES (20)..(20): Xaa is Aib
  MISC_FEATURE (24)..(24): PEG (40kDa) covalently attached to Cysteine
  MISC_FEATURE (40)..(40): 14 Carbon fatty acyl group covalently attached to Lysine
  MISC_FEATURE (40)..(40): C-terminal amidation

SEQ ID NO: 267 - protein, 40 aa, Artificial Sequence
  Synthetic polypeptide
  MISC_FEATURE (1)..(40): mt-241
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAKEFVNWLLAGGPSSGAPPPSC

SEQ ID NO: 268 - protein, 40 aa, Artificial Sequence
  Synthetic polypeptide
  MISC_FEATURE (1)..(40): mt-242
  MOD_RES (2)..(2): Xaa is Aib
  MOD_RES (16)..(16): Xaa is Aib
  MISC_FEATURE (40)..(40): C-terminal amidation
YXQGTFTSDYSIYLDXQAAQEFVNWLLAGGPSSGAPPPSC

SEQ ID NO: 269 - protein, 40 aa, Artificial Sequence
  Synthetic polypeptide
  MISC_FEATURE (1)..(40): mt-273
  MOD_RES (2)..(2): Xaa is Aib
  MOD_RES (12)..(16): Lactam bridge between residues 12 and 16
  MOD_RES (20)..(20): Xaa is Aib
  MOD_RES (40)..(40): C-terminal amidation
YXQGTFTSDYSKYLDEQAAXEFVNWLLAGGPSSGAPPPSC

SEQ ID NO: 270 - protein, 10 aa, Artificial Sequence
  Synthetic polypeptide
GPSSGAPPPK

SEQ ID NO: 271 - protein, 11 aa, Artificial Sequence
  Synthetic polypeptide
  MOD_RES (1)..(1): Xaa is Gly or a small, aliphatic or non-polar or slightly polar amino acid
XGPSSGAPPPK

SEQ ID NO: 272 - protein, 12 aa, Artificial Sequence
  Synthetic  polypeptide
  MOD_RES (1)..(1): Xaa is Gly or a small, aliphatic or non-polar or slightly polar amino acid
XGPSSGAPPPSK

SEQ ID NO: 273 - protein, 40 aa, Artificial Sequence; identical to SEQ ID NO: 267
  Synthetic polypeptide
  MISC_FEATURE (1)..(40): mt-248
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 274 - protein, 40 aa, Artificial Sequence; identical to SEQ ID NO: 268
  Synthetic polypeptide
  MISC_FEATURE (1)..(40): mt-249
  MOD_RES (2)..(2): Xaa is Aib
  MOD_RES (16)..(16): Xaa is Aib
  MISC_FEATURE (40)..(40): PEG (40kDa) covalently attached to Cysteine
  MISC_FEATURE (40)..(40): C-terminal amidation

SEQ ID NO: 275 - protein, 40 aa, Artificial Sequence; identical to SEQ ID NO: 221
  Synthetic polypeptide
  MISC_FEATURE (1)..(40): mt-250
  MOD_RES (2)..(2): Xaa is Aib
  MOD_RES (16)..(16): Xaa is Aib
  MOD_RES (20)..(20): Xaa is Aib
  MISC_FEATURE (40)..(40): C-terminal amidation

SEQ ID NO: 276 - protein, 40 aa, Artificial Sequence
  Synthetic polypeptide
  MISC_FEATURE (1)..(40): mt-251
  MOD_RES (2)..(2): Xaa is Aib
  MOD_RES (20)..(20): Xaa is Aib
  MISC_FEATURE (40)..(40): C-terminal amidation
YXQGTFTSDYSIYLDEQAAXEFVNWLLAGGPSSGAPPPSC

SEQ ID NO: 277 - protein, 29 aa, Artificial Sequence
  Synthetic polypeptide
  MISC_FEATURE (1)..(29): mt-258
  MOD_RES (2)..(2): Xaa is Aib
  MOD_RES (20)..(20): Xaa is Aib
  MISC_FEATURE (29)..(29): C-terminal amidation
YXQGTFTSDYSIYLDEQAAXEFVCWLLAG

SEQ ID NO: 278 - protein, 29 aa, Artificial Sequence
  Synthetic polypeptide
  MISC_FEATURE (1)..(29): mt-259
  MOD_RES (2)..(2): Xaa is Aib
  MOD_RES (20)..(20): Xaa is Aib
  MISC_FEATURE (40)..(40): C-terminal amidation
YXQGTFTSDYSIYLDSQAAXEFVCWLLAG

SEQ ID NO: 279 - protein, 30 aa, Artificial Sequence
  Synthetic polypeptide
  MOD_RES (2)..(2): Xaa is Aib
  MISC_FEATURE (24)..(24): PEG (40kDa) covalently attached to Cysteine
HXEGTFTSDVSSYLEEQAAKEFICWLVKGR

SEQ ID NO: 280 - protein, 42 aa, Artificial Sequence
  Synthetic polypeptide
  MISC_FEATURE (1)..(42): SEQ ID NO: 24
  MISC_FEATURE (24)..(24): Substituted amino acid covalently linked to hydrophilic group
YAPGTFISDYSIAMDKIHQQDFVXWLLAQKGKKNWLKHNITQ

SEQ ID NO: 281 - protein, 40 aa, Artificial Sequence
  Synthetic polypeptide
  MISC_FEATURE (1)..(40): SEQ ID NO: 69
  MOD_RES (2)..(2): Xaa is Aib
  MISC_FEATURE (16)..(20): Lactam bridge between residues 16 and 20
  MISC_FEATURE (40)..(40): Substituted amino acid covalentaly linked to hydrophilic group
YXQGTFTSDYSIYLDEQAAKEFVNWLLAGGPSSGAPPPSX

SEQ ID NO: 282 - protein, 29 aa, Artificial Sequence
  Synthetic polypeptide
  MISC_FEATURE (1)..(29): SEQ ID NO: 70
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
  misc_feature (29)..(29): Xaa can be any naturally occurring amino acid
YXQGTFTSDYSIYLDEQAAKEFVXWLLAX

SEQ ID NO: 283 - protein, 39 aa, Artificial Sequence
  Synthetic polypeptide
  MISC_FEATURE (1)..(39): SEQ ID NO: 72
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLLAGGPSSGAPPPS

SEQ ID NO: 284 - protein, 40 aa, Artificial Sequence
  Synthetic polypeptide
  MISC_FEATURE (1)..(40): SEQ ID NO: 75
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGGPSSGAPPPSX

SEQ ID NO: 285 - protein, 29 aa, Artificial Sequence
  Synthetic polypeptide
  MISC_FEATURE (1)..(29): SEQ ID NO: 76
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFISDYSIYLDEQAAKEFVXWLLAG

SEQ ID NO: 286 - protein, 40 aa, Artificial Sequence
  Synthetic polypeptide
  MISC_FEATURE (1)..(40): SEQ ID NO: 77
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXQGTFISDYSIYLDEQAAKEFVNWLLAGGPSSGAPPPSX

SEQ ID NO: 287 - protein, 29 aa, Artificial sequence
  Synthetic polypeptide
  MISC_FEATURE (1)..(29): SEQ ID NO: 78
  MOD_RES (2)..(2): Xaa is Aib
  MISC_FEATURE (16)..(20): Lactam bridge between residues 16 and 20
  MISC_FEATURE (24)..(24): Substituted amino acid covalently linked to hydrophilic group
YXQGTFTSDYSIYLDEQAAKEFVXWLMNG

SEQ ID NO: 288 - protein, 40 aa, Artificial sequence
  Synthetic polypeptide
  MISC_FEATURE (1)..(40): SEQ ID NO: 87
  MOD_RES (2)..(2): Xaa is Aib
  MISC_FEATURE (16)..(20): Lactam bridge between residues 16 and 20
  MISC_FEATURE (40)..(40): Substitute amino acid covalently linked to hydrophilic group
YXQGTFVSDYSIYLDEQAAKEFVNWLLAGGPSSGAPPPSX

SEQ ID NO: 289 - protein, 40 aa, Artificial sequence
  Synthetic polypeptide
  MISC_FEATURE (1)..(40): SEQ ID NO: 88
  MOD_RES (2)..(2): Xaa is Aib
  MISC_FEATURE (16)..(20): Lactam bridge between residues 16 and 20
  MOD_RES (27)..(27): Xaa is Nle
  MISC_FEATURE (40)..(40): Substituted amino acid covalently linked to hydrophilic group
YXQGTFTSDYSIYLDEQAAKEFVNWLXAGGPSSGAPPPSX

SEQ ID NO: 290 - protein, 40 aa, Artificial sequence
  Synthetic polypeptide
  MISC_FEATURE (1)..(40): SEQ ID NO: 90
  MOD_RES (2)..(2): Xaa is Aib
  MISC_FEATURE (16)..(20): Lactam bridge between residues 16 and 20
  MISC_FEATURE (40)..(40): Substituted amino acid covalently linked to hydrophilic group
YXEGTFTSDYSIYLDEQAAKEFVNWLLAGRPSSGAPPPSX

SEQ ID NO: 291 - protein, 43 aa, Artificial sequence
  Synthetic polypeptide
  MISC_FEATURE (1)..(43): SEQ ID NO: 93
  MOD_RES (2)..(2): Xaa is Aib
  MISC_FEATURE (16)..(20): Lactam bridge between residues 16 and 20
  MISC_FEATURE (43)..(43): Substituted amino acid covalently linked to hydrophilic group
YXEGTFTSDYSIYLDEQAAKEFVNWLLAGKGKKNWLKHNITQX

SEQ ID NO: 292 - protein, 40 aa, Artificial Sequence
  Synthetic polypeptide
  MISC_FEATURE (1)..(40): SEQ ID NO: 99
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXEGTFTSDYSIYLDKQAAXEFVNWLLAGGPSSGAPPPSX

SEQ ID NO: 293 - protein, 40 aa, Artificial Sequence
  Synthetic polypeptide
  MISC_FEATURE (1)..(40): SEQ ID NO: 100
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXEGTFTSDYSIYLDKQAAXEFVXWLLAGGPSSGAPPPSK

SEQ ID NO: 294 - protein, 40 aa, Artificial Sequence
  Synthetic polypeptide
  MISC_FEATURE (1)..(40): SEQ ID NO: 101, 102, 103
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substitute amino acid covalently linked to an acyl or alkyl group
  MISC_FEATURE (40)..(40): C-terminal amidation
YXEGTFTSDYSIYLDKQAAXEFVXWLLAGGPSSGAPPPSX

SEQ ID NO: 295 - protein, 40 aa, Artificial Sequence; identical to SEQ ID NO: 292
  Synthetic polypeptide
  MISC_FEATURE (1)..(40): SEQ ID NO: 104, 105, 106
  MOD_RES (2)..(2): Xaa is Aib
  MOD_RES (20)..(20): Xaa is Aib
  MISC_FEATURE (40)..(40): Substituted amino acid covalently linked to an acyl or alkyl group
  MISC_FEATURE (40)..(40): C-terminal amidation

SEQ ID NO: 296 - protein, 40 aa, Artificial Sequence
  Synthetic polypeptide
  MISC_FEATURE (1)..(40): SEQ ID NO: 108
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDKQAAXEFVNWLLAGGPSSGAPPPSX

SEQ ID NO: 297 - protein, 39 aa, Artificial Sequence
  Synthetic polypeptide
  MISC_FEATURE (1)..(39): SEQ ID NO: 113, 114, 115
  MOD_RES (2)..(2): Xaa is Aib
  MOD_RES (20)..(20): Xaa is Aib
  MISC_FEATURE (24)..(24): Substituted amino acid covalently linked to acyl or alkyl group
  MISC_FEATURE (39)..(39): C-terminal amidation
YXEGTFTSDYSIYLDKQAAXEFVXWLLAGGPSSGAPPPS

SEQ ID NO: 298 - protein, 39 aa, Artificial Sequence
  Synthetic polypeptide
  MISC_FEATURE (1)..(39): SEQ ID NO: 117, 118, 119
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (39)..(39): C-terminal amidation
YXEGTFTSDXSIYLDKQAAXEFVNWLLAGGPSSGAPPPS

SEQ ID NO: 299 - protein, 40 aa, Artificial Sequence; identical to SEQ ID NO: 296
  Synthetic polypeptide
  MISC_FEATURE (1)..(40): SEQ ID NO: 123, 124, 125
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 300 - protein, 29 aa, Artificial Sequence
  Synthetic polypeptide
  MISC_FEATURE (1)..(29): SEQ ID NO: 127
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (29)..(29): C-terminal amidation
YXQGTFTSDYSIYLDKQAAXEFVXWLLAG

SEQ ID NO: 301 - protein, 29 aa, Artificial Sequence
  Synthetic polypeptide
  MISC_FEATURE (1)..(29): SEQ ID NO: 128, 129, 130
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (29)..(29): C-terminal amidation
YXEGTFTSDXSIYLDKQAAXEFVNWLLAG

SEQ ID NO: 302 - protein, 40 aa, Artificial Sequence
  Synthetic polypeptide
  MISC_FEATURE (1)..(40): SEQ ID NO: 132
  MOD_RES (2)..(2): Xaa is Aib
  MOD_RES (20)..(20): Xaa is Aib
  MISC_FEATURE (40)..(40): Substituted amino acid covalently linked acyl or alkyl group
  MISC_FEATURE (40)..(40): C-terminal amidation
YXQGTFTSDYSIYLDKQAAXEFVCWLLAGGPSSGAPPPSX

SEQ ID NO: 303 - protein, 40 aa, Artificial Sequence
  Synthetic polypeptide
  MISC_FEATURE (1)..(40): SEQ ID NO: 136, 137, 138
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLLAGGPSSGAPPPSX

SEQ ID NO: 304 - protein, 40 aa, Artificial Sequence
  Synthetic polypeptide
  MISC_FEATURE (1)..(40): SEQ ID NO: 139
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation
YXQGTFTSDYSIYLDKQAAXEFVXWLLAGGPSSGAPPPSK

SEQ ID NO: 305 - protein, 40 aa, Artificial Sequence; identical to SEQ ID NO: 292
  Synthetic polypeptide
  MISC_FEATURE (1)..(40): SEQ ID NO: 140
  MOD_RES (2)..(2): Xaa is Aib
  MOD_RES (20)..(20): Xaa is Aib
  MISC_FEATURE (40)..(40): Substituted amino acid covalently linked to hydrophilic group
  MISC_FEATURE (40)..(40): C-terminal amidation

SEQ ID NO: 306 - protein, 40 aa, Artificial Sequence; identical to SEQ ID NO: 254
  Synthetic polypeptide
  MISC_FEATURE (1)..(40): SEQ ID NO: 141
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 307 - protein, 40 aa, Artificial Sequence
  Synthetic polypeptide
  MISC_FEATURE (1)..(40): SEQ ID NO: 142
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVCWLMNGGPSSGAPPPSX

SEQ ID NO: 308 - protein, 40 aa, Artificial Sequence
  Synthetic polypeptide
  MISC_FEATURE (1)..(40): SEQ ID NO: 143
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation
YXQGTFTSDYSIYLDKQAAXEFVXWLMNGGPSSGAPPPSX

SEQ ID NO: 309 - protein, 40 aa, Artificial Sequence; identical to SEQ ID NO: 254
  Synthetic polypeptide
  MISC_FEATURE (1)..(40): SEQ ID NO: 144, 145
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 310 - protein, 40 aa, Artificial Sequence; identical to SEQ ID NO: 296
  Synthetic polypeptide
  MISC_FEATURE (1)..(40): SEQ ID NO: 148
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 311 - protein, 40 aa, Artificial Sequence; identical to SEQ ID NO: 302
  Synthetic polypeptide
  MISC_FEATURE (1)..(40): SEQ ID NO: 152
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 312 - protein, 40 aa, Artificial Sequence; identical to SEQ ID NO: 254
  Synthetic polypeptide
  MISC_FEATURE (1)..(40): SEQ ID NO: 152
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 313 - protein, 40 aa, Artificial Sequence; identical to SEQ ID NO: 293
  Synthetic polypeptide
  MISC_FEATURE (1)..(40): SEQ ID NO: 153
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 314 - protein, 40 aa, Artificial Sequence; identical to SEQ ID NO: 254
  Synthetic polypeptide
  MISC_FEATURE (1)..(40): SEQ ID NO: 154
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (40)..(40): C-terminal amidation

SEQ ID NO: 315 - protein, 40 aa, Artificial Sequence; identical to SEQ ID NO: 294
  Synthetic polypeptide
  MISC_FEATURE (1)..(40): SEQ ID NO: 156
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 316 - protein, 40 aa, Artificial Sequence; identical to SEQ ID NO: 294
  Synthetic polypeptide
  MISC_FEATURE (1)..(40): SEQ ID NO: 157
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): C-terminal amidation

SEQ ID NO: 317 - protein, 39 aa, Artificial Sequence
  Synthetic polypeptide
  MISC_FEATURE (1)..(39): SEQ ID NO: 235
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (39)..(39): C-terminal amidation
YXEGTFTSDXSIYLDKQAAXEFVCWLLAGGPSSGAPPPS

SEQ ID NO: 318 - protein, 41 aa, Artificial Sequence
  Synthetic polypeptide
  MISC_FEATURE (1)..(41): SEQ ID NO: 160
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): C-terminal amidation
YXEGTFTSDYSIYLDKQAAXEFVNWLLAGGPSSGAPPPSXC

SEQ ID NO: 319 - protein, 39 aa, Artificial Sequence
  Synthetic polypeptide
  MISC_FEATURE (1)..(39): SEQ ID NO: 162
  MOD_RES (2)..(2): Xaa is Aib
  MISC_FEATURE (10)..(10): Substituted amino acid covalently linked to acyl or alkyl group
  MOD_RES (20)..(20): Xaa is Aib
  MISC_FEATURE (24)..(24): Substituted amino acid covalently linked to hydrophilic group
  MISC_FEATURE (39)..(39): C-terminal amidation
YXEGTFTSDXSIYLDKQAAXEFVXWLLAGGPSSGAPPPS

SEQ ID NO: 320 - protein, 41 aa, Artificial Sequence
  Synthetic polypeptide
  MISC_FEATURE (1)..(41): SEQ ID NO: 163
  MOD_RES (2)..(2): Xaa is Aib
  MOD_RES (20)..(20): Xaa is Aib
  MISC_FEATURE (40)..(40): Substituted amino acid covalently linked to acyl or alkyl group
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSXX

SEQ ID NO: 321 - protein, 41 aa, Artificial Sequence
  Synthetic polypeptide
  MISC_FEATURE (1)..(41): SEQ ID NO: 164
  MOD_RES (2)..(2): Xaa is Aib
  MOD_RES (20)..(20): Xaa is Aib
  MISC_FEATURE (41)..(41): Substituted amino acid covalently linked to hydrophilic group
  MISC_FEATURE (41)..(41): C-terminal amidation
YXEGTFTSDYSIYLDKQAAXEFVNWLLAGGPSSGAPPPSKX

SEQ ID NO: 322 - protein, 40 aa, Artificial Sequence
  Synthetic polypeptide
  MISC_FEATURE (1)..(40): SEQ ID NO: 165
  MOD_RES (2)..(2): Xaa is Aib
  MISC_FEATURE (40)..(40): Substituted amino acid covalently linked to acyl or alkyl group
  MISC_FEATURE (40)..(40): C-terminal amidation
HXQGTFTSDYSKYLDEQAAKEFICWLMNGGPSSGAPPPSX

SEQ ID NO: 323 - protein, 40 aa, Artificial Sequence; identical to SEQ ID NO: 294
  Synthetic polypeptide
  MISC_FEATURE (1)..(40): SEQ ID NO: 166
  MOD_RES (2)..(2): Xaa is Aib
  MOD_RES (20)..(20): Xaa is Aib
  MISC_FEATURE (24)..(24): Substituted amino acid covalently linked to hydrophilic group
  MISC_FEATURE (40)..(40): Substituted amino acid covalently linked to acyl or alkyl group
  MISC_FEATURE (40)..(40): C-terminal amidation

SEQ ID NO: 324 - protein, 40 aa, Artificial Sequence
  Synthetic polypeptide
  MISC_FEATURE (1)..(40): SEQ ID NO: 173
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAKEFVNWLLAGGPSSGAPPPSX

SEQ ID NO: 325 - protein, 40 aa, Artificial Sequence
  Synthetic polypeptide
  MISC_FEATURE (1)..(40): SEQ ID NO: 174
  MOD_RES (2)..(2): Xaa is Aib
  MOD_RES (16)..(16): Xaa is Aib
  MISC_FEATURE (40)..(40): Substituted amino acid covalently linked to hydrophilic group
  MISC_FEATURE (40)..(40): C-terminal amidation
YXQGTFTSDYSIYLDXQAAQEFVNWLLAGGPSSGAPPPSX

SEQ ID NO: 326 - protein, 30 aa, Artificial Sequence; identical to SEQ ID NO: 279
  Synthetic polypeptide
  MOD_RES (2)..(2): Xaa is Aib
  MISC_FEATURE (24)..(24): Substituted amino acid covalently linked to hydrophilic group

SEQ ID NO: 327 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSIYLDKQAAXEFVNWLLAG

SEQ ID NO: 328 - protein, 29 aa, Artificial Sequence
  Synthetic polypeptide
  MOD_RES (2)..(2): Xaa is D-Ser, DAla, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MISC_FEATURE (29)..(29): C-terminal amidation
YXQGTFTSDYSIYLDXQAAXEFVNWLXXX

SEQ ID NO: 329 - protein, 29 aa, Artificial Sequence
  Synthetic polypeptide
  MOD_RES (2)..(2): Xaa is Aib
  MOD_RES (20)..(20): Xaa is Aib
  MISC_FEATURE (29)..(29): C-terminal amidation
YXQGTFTSDYSKYLDKRRAXDFVQWLLAG

SEQ ID NO: 330 - protein, 29 aa, Artificial Sequence
  Synthetic polypeptide
  MOD_RES (2)..(2): Xaa is D-Ser, DAla, Val, Gly, N-Methyl Ser, N-Methyl Ala, or Aib
  MOD_RES (16)..(16): Xaa is Lys, Glu, Ser, Orn, Dab, Aib or any alpha, alpha-disubstituted amino acid
  MOD_RES (20)..(20): Xaa is any alpha, alpha-disubstituted amino acid
  MOD_RES (27)..(27): Xaa is Ile, Leu, or Nle
  MOD_RES (28)..(28): Xaa is Ala or Gly
  MOD_RES (29)..(29): Xaa is Thr, Ala, or Gly
  MOD_RES (29)..(29): C-terminal amidation
YXQGTFTSDYSKYLDXRRAXDFVQWLXXX

SEQ ID NO: 331 - protein, 41 aa, Artificial Sequence; identical to SEQ ID NO: 260
  Synthetic polypeptide
  MISC_FEATURE (1)..(41): Mt-354
  MISC_FEATURE (1)..(40): Homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MOD_RES (40)..(40): C-terminal amidation
  DISULFID (41)..(41): Disulfide bond formed with Cys residue of a second peptide having the same structure.

SEQ ID NO: 332 - protein, 40 aa, Artificial Sequence
  Synthetic polypeptide
  MISC_FEATURE (1)..(40): Mt-356
  MOD_RES (2)..(2): Xaa is Aib
  MOD_RES (20)..(20): Xaa is Aib
  MISC_FEATURE (40)..(40): C-terminal amidation
YXQGTFTSDYSIYLDKQAAXEFVNWLMNGGPSSGAPPPSK

SEQ ID NO: 333 - protein, 40 aa, Artificial Sequence
  Synthetic polypeptide
  MISC_FEATURE (1)..(40): Mt-357
  MOD_RES (2)..(2): Xaa is Aib
  MOD_RES (20)..(20): Xaa is Aib
  MISC_FEATURE (40)..(40): C-terminal amidation
YXQGTFISDYSIYLDKQAAXEFVNWLLAGGPSSGAPPPSK

SEQ ID NO: 334 - protein, 40 aa, Artificial Sequence; identical to SEQ ID NO: 333
  Synthetic polypeptide
  MISC_FEATURE (1)..(40): Mt-358
  MOD_RES (2)..(2): Xaa is Aib
  MOD_RES (20)..(20): Xaa is Aib
  MISC_FEATURE (40)..(40): 16 Carbon fatty acyl group covalently bound to Lysine
  MISC_FEATURE (40)..(40): C-terminal amidation

SEQ ID NO: 335 - protein, 40 aa, Artificial Sequence; identical to SEQ ID NO: 36
  Synthetic polypeptide
  MISC_FEATURE (1)..(40): Mt-367
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a gamma-Glu-gamma-Glu spacer
  MISC_FEATURE (40)..(40): C-terminal amidation

SEQ ID NO: 336 - protein, 40 aa, Artificial Sequence; identical to SEQ ID NO: 223
  Synthetic polypeptide
  MISC_FEATURE (1)..(40): Mt-368
  MOD_RES (2)..(2): Xaa is Aib
  MOD_RES (20)..(20): Xaa is Aib
  MISC_FEATURE (40)..(40): 16 Carbon fatty acyl group covalently bound to Lysine via a gamma-Glu-gamma-Glu spacer
  MISC_FEATURE (40)..(40): C-terminal amidation

SEQ ID NO: 337 - protein, 40 aa, Artificial Sequence
  Synthetic polypeptide
  MISC_FEATURE (1)..(40): Mt-369
  MOD_RES (2)..(2): Xaa is Aib
  MISC_FEATURE (10)..(10): 16 Carbon fatty acyl group covalently bound to Lysine via gamma-Glu-gamma-Glu spacer
  MOD_RES (20)..(20): Xaa is Aib
  MISC_FEATURE (40)..(40): C-terminal amidation
YXEGTFTSDKSIYLDKQAAXEFVNWLLAGGPSSGAPPPSK

SEQ ID NO: 338 - protein, 41 aa, Artificial Sequence; identical to SEQ ID NO: 260
  Synthetic polypeptide
  MISC_FEATURE (1)..(41): Mt-376
  MISC_FEATURE (1)..(40): Homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MISC_FEATURE (41)..(41): C-terminal amidation
  MISC_FEATURE (41)..(41): Cys residue covalently attached to 20 kDa PEG which is in turn covalently attached to a Cys residue of a second peptide having the same structure

SEQ ID NO: 339 - protein, 41 aa, Artificial Sequence; identical to SEQ ID NO: 260
  Synthetic polypeptide
  MISC_FEATURE (1)..(41): Mt-377
  MISC_FEATURE (1)..(40): homodimer
  MOD_RES (2)..(2): Xaa is Aib
  MOD_RES (20)..(20): Xaa is Aib
  MISC_FEATURE (40)..(40): 14 Carbon fatty acyl group covalently bound to Lysine
  MISC_FEATURE (41)..(41): PEG (5kDa) covalently bound to Cysteine
  MISC_FEATURE (41)..(41): C-terminal amidation
  MISC_FEATURE (41)..(41): Cys residue covalently attached to 5 kDa PEG which is in turn covalently attached to a Cys residue of a second peptide having the same structure

SEQ ID NO: 340 - protein, 29 aa, Artificial Sequence
  Synthetic polypeptide
  MISC_FEATURE (1)..(29): Peptide J
  MOD_RES (3)..(3): Xaa is a Glutamine analog
  MOD_RES (27)..(27): Xaa is Nle
HSXGTFTSDYSKYLDTRRAAEFVAWLXDE

SEQ ID NO: 341 - protein, 29 aa, Artificial Sequence
  Synthetic polypeptide
  MISC_FEATURE (1)..(29): Peptide K
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 342 - protein, 29 aa, Artificial Sequence
  Synthetic polypeptide
  MOD_RES (27)..(27): Xaa is Nle
HSQGTFTSDYSKYLDTRRAAEFVAWLXDE

SEQ ID NO: 343 - protein, 29 aa, Artificial Sequence
  Synthetic peptide
  MOD_RES (3)..(3): Xaa is Acetamidomethyl-cysteine
  MOD_RES (27)..(27): Xaa is Nle
HSXGTFTSDYSKYLDTRRAAEFVAWLXDE

SEQ ID NO: 344 - protein, 29 aa, Artificial Sequence
  Synthetic peptide
  MOD_RES (3)..(3): Xaa is Acetyldiaminobutanoic acid
  MOD_RES (27)..(27): Xaa is Nle
HSXGTFTSDYSKYLDTRRAAEFVAWLXDE

SEQ ID NO: 345 - protein, 29 aa, Artificial Sequence
  Synthetic polypeptide
  MOD_RES (3)..(3): Xaa is carbamoyldiaminopropanoic acid
  MOD_RES (27)..(27): Xaa is Nle
HSXGTFTSDYSKYLDTRRAAEFVAWLXDE

SEQ ID NO: 346 - protein, 29 aa, Artificial Sequence
  Synthetic polypeptide
  MOD_RES (3)..(3): Xaa is Methylglutamine
  MOD_RES (27)..(27): Xaa is Nle
HSXGTFTSDYSKYLDTRRAAEFVAWLXDE

SEQ ID NO: 347 - protein, 29 aa, Artificial Sequence
  Synthetic peptide
  MOD_RES (3)..(3): Xaa is Methionine sulfoxide
  MOD_RES (27)..(27): Xaa is Nle
HSXGTFTSDYSKYLDTRRAAEFVAWLXDE

SEQ ID NO: 348 - protein, 29 aa, Artificial Sequence
  Synthetic peptide
  MOD_RES (3)..(3): Xaa is Acetylornithine
  MOD_RES (27)..(27): Xaa is Nle
HSXGTFTSDYSKYLDTRRAAEFVAWLXDE

SEQ ID NO: 349 - protein, 29 aa, Artificial Sequence
  Synthetic polypeptide
  MOD_RES (16)..(16): Xaa is Aib
HSQGTFTSDYSKYLDXRRAADFVAWLMDE

SEQ ID NO: 350 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLMDE

SEQ ID NO: 351 - protein, 29 aa, Artificial Sequence
  Synthetic polypeptide
  MOD_RES (3)..(3): Xaa is Methylglutamine
  MOD_RES (16)..(16): Xaa is Aib
HSXGTFTSDYSKYLDXRRAADFVAWLMDE

SEQ ID NO: 352 - protein, 29 aa, Artificial Sequence
  Synthetic polypeptide
HSQGTFTSDYSKYLDSRRAQDFVQWLMDT

SEQ ID NO: 353 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRAADFVAWLLDE

SEQ ID NO: 354 - protein, 39 aa, Artificial Sequence
  Synthetic polypeptide
  MOD_RES (3)..(3): Xaa is Acetyldiaminobutanoic acid
  MOD_RES (16)..(16): Xaa is Aib
  MISC_FEATURE (39)..(39): C-terminal amidation
HSXGTFTSDYSKYLDXRRAADFVAWLLDTGPSSGAPPPS

SEQ ID NO: 355 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRASDFVSWLLDE

SEQ ID NO: 356 - protein, 29 aa, Artificial Sequence
  Synthetic polypeptide
  MOD_RES (3)..(3): Xaa is Acetyldiaminobutanoic acid
  MOD_RES (16)..(16): Xaa is Aib
HSXGTFTSDYSKYLDXRRATDFVTWLLDE

SEQ ID NO: 357-358 - skipped (2 entries)

SEQ ID NO: 359 - protein, 40 aa, Artificial Sequence; identical to SEQ ID NO: 23
  Synthetic peptide
  MISC_FEATURE (1)..(40): mt-225
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Ala-Ac-Cys(PEG), wherein the Ac-Cys(PEG) is a Cys residue comprising an alpha amino group capped with an acetyl group (CH3CO) and comprising a 40 kDa PEG covalently attached to its side chain

SEQ ID NO: 360 - protein, 40 aa, Artificial Sequence; identical to SEQ ID NO: 23
  Synthetic peptide
  MISC_FEATURE (1)..(40): mt-227
  MOD_RES (2)..(2): Xaa is Aib
  MISC_FEATURE (16)..(20): Lactam bridge links Glu16 and Lys20
  MOD_RES (40)..(40): Epsilon amine of Lys is attached to Arg-Ac-Cys(PEG), wherein the Ac-Cys(PEG) is a Cys residue comprising an alpha amino group capped with an acetyl group (CH3CO) and comprising a 40 kDa PEG covalently attached to its side chain

SEQ ID NO: 361 - protein, 40 aa, Artificial Sequence; identical to SEQ ID NO: 171
  Synthetic peptide
  MISC_FEATURE (1)..(40): mt-294
  MOD_RES (2)..(2): Xaa is Aib
  MISC_FEATURE (16)..(20): Lactam bridge links Glu16 and Lys20
  MOD_RES (40)..(40): Cys-PEG covalently linked via thioether linkage

SEQ ID NO: 362 - protein, 40 aa, Artificial Sequence
  Synthetic peptide
  MOD_RES (2)..(2): Xaa is Aib
HXQGTFTSDYSKYLDERRAQDFVQWLMNTGPSSGAPPPSK

SEQ ID NO: 363-400 - skipped (38 entries)

SEQ ID NO: 401 - protein, 29 aa, Homo sapiens
HSQGTFTSDYSKYLDSRRAQDFVQWLMNT

SEQ ID NO: 402 - protein, 29 aa, Artificial Sequence
  Synthetic Glucagon Analogue
  MOD_RES (16)..(16): Xaa is Glu, Gln, homoglutamic acid or homocysteic acid
  MOD_RES (17)..(17): Xaa is Arg, Cys, Orn, homocysteine or acetyl Phe
  MOD_RES (27)..(27): Xaa is Met, Leu or Nle
HSQGTFTSDYSKYLDXXRAQDFVQWLXNT

SEQ ID NO: 403 - protein, 29 aa, Artificial Sequence
  Synthetic Glucagon Analogue
  MOD_RES (16)..(16): Xaa is Glu, Gln, homoglutamic acid or homocysteic acid
  MOD_RES (21)..(21): Xaa is Asp, Cys, Orn, homocysteine or acetyl Phe
  MOD_RES (27)..(27): Xaa is Met, Leu or Nle
HSQGTFTSDYSKYLDXRRAQXFVQWLXNT

SEQ ID NO: 404 - protein, 29 aa, Artificial Sequence
  Synthetic Glucagon Analogue
  MOD_RES (16)..(16): Xaa is Glu, Gln, homoglutamic acid or homocysteic acid
  MOD_RES (24)..(24): Xaa is Gln, Cys, Orn, homocysteine or acetyl Phe
  MOD_RES (27)..(27): Xaa is Met, Leu or Nle
HSQGTFTSDYSKYLDXRRAQDFVXWLXNT

SEQ ID NO: 405 - protein, 29 aa, Artificial Sequence
  Synthetic Glucagon Analogue
  MOD_RES (16)..(16): Xaa is Glu, Gln, homoglutamic acid or homocysteic acid
  MOD_RES (21)..(21): Xaa is Asp, Cys, Orn, homocysteine or acetyl Phe
  MOD_RES (24)..(24): Xaa is Gln, Cys, Orn, homocysteine or acetyl Phe
  MOD_RES (27)..(27): Xaa is Met, Leu or Nle
HSQGTFTSDYSKYLDXRRAQXFVXWLXNT

SEQ ID NO: 406 - protein, 29 aa, Artificial Sequence
  Synthetic Glucagon Analogue
  MOD_RES (21)..(21): Xaa is Asp, Cys, Orn, homocysteine or acetyl Phe
  MOD_RES (27)..(27): Xaa is Met, Leu or Nle
HSQGTFTSDYSKYLDERRAQXFVQWLXNT

SEQ ID NO: 407 - protein, 29 aa, Artificial Sequence
  Synthetic Glucagon Analogue
  MOD_RES (24)..(24): Xaa is Gln, Cys, Orn, homocysteine or acetyl Phe
  MOD_RES (27)..(27): Xaa is Met, Leu or Nle
HSQGTFTSDYSKYLDERRAQDFVXWLXNT

SEQ ID NO: 408 - protein, 29 aa, Artificial Sequence
  Synthetic Glucagon Analogue
  MOD_RES (16)..(16): Xaa is Glu, Gln, homoglutamic acid or homocysteic acid
HSQGTFTSDYSKYLDXRRAQDFVQWLMNT

SEQ ID NO: 409 - protein, 29 aa, Artificial Sequence
  Synthetic Glucagon Analogue
  MOD_RES (27)..(27): Xaa is Met, Leu or Nle
HSQGTFTSDYSKYLDERRAQDFVQWLXNT

SEQ ID NO: 410 - protein, 29 aa, Artificial Sequence
  Synthetic Glucagon Analogue
HSQGTFTSDYSKYLDERRAQDFVQWLMNT

SEQ ID NO: 411 - protein, 29 aa, Artificial Sequence
  Synthetic Glucagon Analogue
  MOD_RES (29)..(29): AMIDATION
HSQGTFTSDYSKYLDERRAQDFVQWLMNT

SEQ ID NO: 412 - protein, 29 aa, Artificial Sequence
  Synthetic Glucagon Analogue
  MISC_FEATURE (12)..(16): Lactam ring between side chains at position 12 and 16
HSQGTFTSDYSKYLDERRAQDFVQWLMNT

SEQ ID NO: 413 - protein, 29 aa, Artificial Sequence
  Synthetic Glucagon Analogue
  MISC_FEATURE (16)..(20): Lactam ring between side chains at positions 16 and 20
HSQGTFTSDYSKYLDERRAKDFVQWLMNT

SEQ ID NO: 414 - protein, 29 aa, Artificial Sequence
  Synthetic Glucagon Analogue
  MISC_FEATURE (22)..(24): Lactam ring between side chains at positions 22 and 24
HSQGTFTSDYSKYLDSRRAKDFVEWLMNT

SEQ ID NO: 415 - protein, 29 aa, Artificial Sequence
  Synthetic Glucagon Analogue
  MISC_FEATURE (24)..(28): Lactam ring formed between side chains at positions 24 and 28
HSQGTFTSDYSKYLDSRRAQDFVEWLMKT

SEQ ID NO: 416 - protein, 29 aa, Artificial Sequence
  Synthetic Glucagon Analogue
  MISC_FEATURE (12)..(16): Lactam ring between side chains at positions 12 and 16
  MISC_FEATURE (20)..(24): Lactam ring between side chains at positions 20 and 24
HSQGTFTSDYSKYLDERRAKDFVEWLMNT

SEQ ID NO: 417 - protein, 29 aa, Artificial Sequence
  Synthetic Glucagon Analogue
  MISC_FEATURE (16)..(20): Lactam ring between side chains at positions 16 and 20
  MISC_FEATURE (24)..(28): Lactam ring between side chains at positions 24 and 28
HSQGTFTSDYSKYLDERRADDFVEWLMKT

SEQ ID NO: 418 - protein, 29 aa, Artificial Sequence
  Synthetic Glucagon Analogue
  MISC_FEATURE (16)..(20): Lactam ring between side chains at positions 16 and 20
HSQGTFTSDYSKYLDERRAKDFVEWLMKT

SEQ ID NO: 419 - protein, 30 aa, Artificial Sequence
  Synthetic Glucagon Analogue
  MOD_RES (30)..(30): Xaa is a variable amino acid
  MOD_RES (30)..(30): AMIDATION
HSQGTFTSDYSKYLDERRAQDFVQWLMNTX

SEQ ID NO: 420 - protein, 29 aa, Artificial Sequence
  Synthetic Glucagon Analogue
  MOD_RES (16)..(16): Xaa is Ser, Glu, Gln, homoglutamic acid or homocysteic acid
  MOD_RES (20)..(20): Xaa is Gln, Lys, Arg, Orn or Citrulline
  MOD_RES (24)..(24): Xaa is Gln or Glu
  MOD_RES (28)..(28): Xaa is Asn, Asp or Lys
  MOD_RES (29)..(29): Xaa is Thr or Gly
HSQGTFTSDYSKYLDXRRAXDFVXWLMXX

SEQ ID NO: 421 - protein, 29 aa, Artificial Sequence
  Synthetic Glucagon Analogue
  MOD_RES (2)..(2): Xaa is D-Ser, Ala, Gly, N-methyl Ser or Aib
  MOD_RES (29)..(29): AMIDATION
HXQGTFTSDYSKYLDERRAQDFVQWLMNT

SEQ ID NO: 422 - protein, 29 aa, Artificial Sequence
  Synthetic Glucagon Analogue
  MOD_RES (2)..(2): Aminoisobutyric acid
  MISC_FEATURE (29)..(29): c-term amidation
HXQGTFTSDYSKYLDERRAQDFVQWLMNT

SEQ ID NO: 423 - protein, 29 aa, Artificial Sequence
  Synthetic Glucagon Analogue
  MOD_RES (17)..(17): Bound to PEG
  MOD_RES (27)..(27): Xaa is Met, Leu or Nle
  MOD_RES (29)..(29): AMIDATION
HSQGTFTSDYSKYLDECRAQDFVQWLXNT

SEQ ID NO: 424 - protein, 29 aa, Artificial Sequence
  Synthetic Glucagon Analogue
  MOD_RES (21)..(21): Bound to PEG
  MOD_RES (27)..(27): Xaa is Met, Leu or Nle
  MOD_RES (29)..(29): AMIDATION
HSQGTFTSDYSKYLDERRAQCFVQWLXNT

SEQ ID NO: 425 - protein, 29 aa, Artificial Sequence
  Synthetic Glucagon Analogue
  MOD_RES (24)..(24): Bound to PEG
  MOD_RES (27)..(27): Xaa is Met, Leu or Nle
  MOD_RES (29)..(29): AMIDATION
HSQGTFTSDYSKYLDERRAQDFVCWLXNT

SEQ ID NO: 426 - protein, 10 aa, Artificial Sequence
  Synthetic peptide fragment representing the carboxy terminal 10 amino acids Exendin-4
GPSSGAPPPS

SEQ ID NO: 427 - protein, 8 aa, Artificial Sequence
  Synthetic peptide fragment representing the carboxy terminal 8 amino acids of oxyntomodulin
KRNRNNIA

SEQ ID NO: 428 - protein, 4 aa, Artificial Sequence
  Synthetic peptide
KRNR

SEQ ID NO: 429 - protein, 10 aa, Artificial Sequence
  Synthetic peptide fragment representing the carboxy terminal 10 amino acids of Exendin-4
  MOD_RES (10)..(10): AMIDATION
GPSSGAPPPS

SEQ ID NO: 430 - protein, 39 aa, Artificial Sequence
  Synthetic Glucagon Analogue
  MOD_RES (27)..(27): Xaa is Met, Leu or Nle
HSQGTFTSDYSKYLDERRAQDFVQWLXNTGPSSGAPPPS

SEQ ID NO: 431 - protein, 37 aa, Artificial Sequence
  Synthetic Glucagon Analogue
  MOD_RES (27)..(27): Xaa is Met, Leu or Nle
HSQGTFTSDYSKYLDERRAQDFVQWLXNTKRNRNNIA

SEQ ID NO: 432 - protein, 33 aa, Artificial Sequence
  Synthetic Glucagon Analogue
  MOD_RES (27)..(27): Xaa is Met, Leu or Nle
HSQGTFTSDYSKYLDERRAQDFVQWLXNTKRNR

SEQ ID NO: 433 - protein, 29 aa, Artificial Sequence
  Synthetic Glucagon Analogue
  MOD_RES (15)..(15): Xaa is Asp, Glu, homoglutamic acid, cysteic acid or homocysteic acid
  MOD_RES (16)..(16): Xaa is Ser, Glu, Gln, homoglutamic acid or homocysteic acid
  MOD_RES (20)..(20): Xaa is Gln or Lys
  MOD_RES (24)..(24): Xaa is Gln or Glu
  MOD_RES (28)..(28): Xaa is Asn, Lys or an acidic amino acid
  MOD_RES (29)..(29): Xaa is Thr, Gly or an acidic amino acid
HSQGTFTSDYSKYLXXRRAXDFVXWLMXX

SEQ ID NO: 434 - protein, 29 aa, Artificial Sequence
  Synthetic Glucagon Analogue
  MOD_RES (15)..(15): Xaa is Asp, Glu, cysteic acid, homoglutamic acid or homocysteic acid
  MOD_RES (16)..(16): Xaa is Ser, Glu, Gln, homoglutamic acid or homocysteic acid
  MOD_RES (20)..(20): Xaa is Gln or Lys
  MOD_RES (24)..(24): Xaa is Gln or Glu
  MOD_RES (28)..(28): Xaa is Asn, Asp or Lys
  MOD_RES (29)..(29): Xaa is Thr or Gly
HSQGTFTSDYSKYLDXRRAXDFVXWLMXX

SEQ ID NO: 435 - protein, 29 aa, Artificial Sequence
  Synthetic Glucagon Analogue
HSQGTFTSDYSKYLDSCRAQDFVQWLMNT

SEQ ID NO: 436 - protein, 39 aa, Artificial Sequence
  Synthetic Glucagon Analogue
HSQGTFTSDYSKYLDSRRAQDFVQWLMNTGPSSGAPPPS

SEQ ID NO: 437 - protein, 29 aa, Artificial Sequence
  Synthetic Glucagon Analogue
  MOD_RES (24)..(24): 2-butyrolactone bound through thiol group of Cys
HSQGTFTSDYSKYLDSRRAQDFVCWLMNT

SEQ ID NO: 438 - protein, 29 aa, Artificial Sequence
  Synthetic Glucagon Analogue
  MOD_RES (24)..(24): Carboxymethyl group bound through thiol group of Cys
HSQGTFTSDYSKYLDSRRAQDFVCWLMNT

SEQ ID NO: 439 - protein, 39 aa, Artificial Sequence
  Synthetic Glucagon Analogue
HSQGTFTSDYSRYLDSRRAQDFVQWLMNTGPSSGAPPPS

SEQ ID NO: 440 - protein, 29 aa, Artificial Sequence
  Synthetic Glucagon Analogue
  MOD_RES (15)..(15): Xaa is Glu or Asp
  MOD_RES (28)..(28): Xaa is Glu or Asp
  MOD_RES (29)..(29): AMIDATION
HSQGTFTSDYSKYLXERRAQDFVQWLMXT

SEQ ID NO: 441 - protein, 29 aa, Artificial Sequence
  Synthetic Glucagon Analogue
  MISC_FEATURE (12)..(16): Lactam ring between side chains at positions 12 and 16
  MOD_RES (15)..(15): Xaa is Glu or Asp
  MOD_RES (28)..(28): Xaa is Glu or Asp
  MOD_RES (29)..(29): AMIDATION
HSQGTFTSDYSKYLXERRAQDFVQWLMXT

SEQ ID NO: 442 - protein, 29 aa, Artificial Sequence
  Synthetic Glucagon Analogue
  MOD_RES (15)..(15): Xaa is Glu or Asp
  MISC_FEATURE (16)..(20): Lactam ring between side chains at positions 16 and 20
  MOD_RES (28)..(28): Xaa is Glu or Asp
  MOD_RES (29)..(29): AMIDATION
HSQGTFTSDYSKYLXERRAKDFVQWLMXT

SEQ ID NO: 443 - protein, 29 aa, Artificial Sequence
  Synthetic Glucagon Analogue
  MOD_RES (15)..(15): Xaa is Glu or Asp
  MISC_FEATURE (20)..(24): Lactam ring between side chains at positions 20 and 24
  MOD_RES (28)..(28): Xaa is Glu or Asp
  MOD_RES (29)..(29): AMIDATION
HSQGTFTSDYSKYLXSRRAKDFVEWLMXT

SEQ ID NO: 444 - protein, 29 aa, Artificial Sequence
  Synthetic Glucagon Analogue
  MOD_RES (15)..(15): Xaa is Glu or Asp
  MISC_FEATURE (24)..(28): Lactam ring between side chains at positions 24 and 28
  MOD_RES (29)..(29): Xaa is Glu or Thr
  MOD_RES (29)..(29): AMIDATION
HSQGTFTSDYSKYLXSRRAQDFVEWLMKX

SEQ ID NO: 445 - protein, 29 aa, Artificial Sequence
  Synthetic Glucagon Analogue
  MOD_RES (12)..(12): Xaa is Lys or Glu
  MOD_RES (15)..(15): Xaa is Asp, Glu, homoglutamic acid, cysteic acid or homocysteic acid
  MOD_RES (16)..(16): Xaa is Ser, Gln, Glu, Lys, homoglutamic acid, cysteic acid or homocysteic acid
  MOD_RES (20)..(20): Xaa is Gln, Glu or Lys
  MOD_RES (24)..(24): Xaa is Gln, Lys or Glu
  MOD_RES (28)..(28): Xaa is Asn, Lys or an acidic amino acid
  MOD_RES (29)..(29): Xaa is Thr, Gly or an acidic amino acid
HSQGTFTSDYSXYLXXRRAXDFVXWLMXX

SEQ ID NO: 446 - protein, 29 aa, Artificial Sequence
  Synthetic Glucagon Analogue
  MOD_RES (16)..(16): Xaa is Ser, Glu, Gln, homoglutamic acid or homocysteic acid
  MOD_RES (20)..(20): Xaa is Gln or Lys
  MOD_RES (24)..(24): Xaa is Gln or Glu
HSQGTFTSDYSKYLDXRRAXDFVXWLMNT

SEQ ID NO: 447 - protein, 29 aa, Artificial Sequence
  Synthetic Glucagon Analogue
HSQGTFTSDYSKYLDERRAKDFVQWLMNT

SEQ ID NO: 448 - protein, 29 aa, Artificial Sequence
  Synthetic Glucagon Analogue
HSQGTFTSDYSKYLDSRRAKDFVEWLMNT

SEQ ID NO: 449 - protein, 29 aa, Artificial Sequence
  Synthetic Glucagon Analogue
HSQGTFTSDYSKYLDSRRAQDFVEWLMKT

SEQ ID NO: 450 - protein, 31 aa, Homo sapiens; identical to SEQ ID NO: 102

SEQ ID NO: 451 - protein, 29 aa, Artificial Sequence
  Synthetic Glucagon Analogue
  MOD_RES (15)..(15): Xaa is Asp, Glu, homoglutamic acid, cysteic acid or homocysteic acid
  MOD_RES (16)..(16): Xaa is Ser, Glu, Gln, homoglutamic acid or homocysteic acid
  MOD_RES (20)..(20): Xaa is Gln, Lys, Arg, Orn, or Cit
  MOD_RES (21)..(21): Xaa is Asp, Glu, homoglutamic acid, or homocysteic acid
  MOD_RES (24)..(24): Xaa is Gln or Glu
  MOD_RES (28)..(28): Xaa is Asn, Lys or an acidic amino acid
  MOD_RES (29)..(29): Xaa is Thr, Gly or an acidic amino acid
HSQGTFTSDYSKYLXXRRAXXFVXWLMXX

SEQ ID NO: 452 - protein, 30 aa, Artificial Sequence; identical to SEQ ID NO: 103
  Synthetic peptide
  MOD_RES (30)..(30): AMIDATION

SEQ ID NO: 453 - protein, 29 aa, Artificial Sequence
  Synthetic Glucagon Analogue
  MOD_RES (3)..(3): Xaa is Glu, Orn or Nle
  MOD_RES (15)..(15): Xaa is Asp, Glu, homoglutamic acid, cysteic acid or homocysteic acid
  MOD_RES (16)..(16): Xaa is Ser, Glu, Gln, homoglutamic acid or homocysteic acid
  MOD_RES (20)..(20): Xaa is Gln or Lys
  MOD_RES (24)..(24): Xaa is Gln or Glu
  MOD_RES (28)..(28): Xaa is Asn, Lys or an acidic amino acid
  MOD_RES (29)..(29): Xaa is Thr or an acidic amino acid
HSXGTFTSDYSKYLXXRRAXDFVXWLMXX

SEQ ID NO: 454 - protein, 29 aa, Artificial Sequence
  Synthetic Glucagon Analogue
  MOD_RES (17)..(17): Xaa is Arg or Gln
  MOD_RES (18)..(18): Xaa is Arg or Ala
  MOD_RES (21)..(21): Xaa is Asp or Glu
  MOD_RES (23)..(23): Xaa is Val or Ile
  MOD_RES (24)..(24): Xaa is Gln or Ala
HSQGTFTSDYSKYLDEXXAKXFXXWLMNT

SEQ ID NO: 455 - protein, 29 aa, Artificial Sequence
  Synthetic Glucagon Analogue
  MOD_RES (1)..(1): Xaa is His, D-His, (Des-amino)His, hydroxyl-His, acetyl-His, homo-His or alpha, alpha-dimethyl imidiazole acetic acid (DMIA), N-methyl His, alpha-methyl His, or imidazole acetic acid
  MOD_RES (2)..(2): Xaa is Ser, D-Ser, Ala, D-Ala, Val, Gly, N-methyl Ser, aminoisobutyric acid (Aib) or N-methyl Ala
  MOD_RES (3)..(3): Xaa is Gln, Glu, Orn or  Nle
  MOD_RES (10)..(10): Xaa is Tyr or Trp
  MOD_RES (12)..(12): Xaa is Lys, Cit, Orn or Arg
  MOD_RES (15)..(15): Xaa is Asp, Glu, cysteic acid, homoglutamic acid and homocysteic acid
  MOD_RES (16)..(16): Xaa is Ser, Glu, Gln, homoglutamic acid or homocysteic acid
  MOD_RES (17)..(17): Xaa is Arg, Gln, Lys, Cys, Orn, homocysteine or acetyl Phe
  MOD_RES (18)..(18): Xaa is Arg, Ala, Lys, Cys, Orn, homocysteine or acetyl Phe
  MOD_RES (20)..(20): Xaa is Gln, Lys, Arg, Orn or Cit
  MOD_RES (21)..(21): Xaa is Gln, Glu, Asp, Lys, Cys, Orn, homocystein or acetyl Phe
  MOD_RES (23)..(23): Xaa is Val or Ile
  MOD_RES (24)..(24): Xaa is Ala, Gln, Glu, Lys, Cys, Orn, homocysteine or acetyl Phe
  MOD_RES (27)..(27): Xaa is Met, Leu or Nle
  MOD_RES (28)..(28): Xaa is Asn, Arg, Cit, Orn, Lys or Asp
  MOD_RES (29)..(29): Xaa is Thr, Gly, Lys, Cys, Orn, homocycsteine or acetyl Phe
XXXGTFTSDXSXYLXXXXAXXFXXWLXXX

SEQ ID NO: 456 - protein, 29 aa, Artificial Sequence
  Synthetic Glucagon Analogue
  MOD_RES (1)..(1): Xaa is His, D-His, (Des-amino)His, hydroxyl-His, acetyl-His, homo-His, DMIA, N-methyl His, alpha-methyl His, or imidazole acetic acid
  MOD_RES (2)..(2): Xaa is Ser, D-Ser, Ala, D-Ala, Val, Gly, N-methyl Ser, AIB or N-methyl Ala
  MOD_RES (3)..(3): Xaa is Gln, Glu, Orn or  Nle
  MOD_RES (15)..(15): Xaa is Asp, Glu, cysteic acid, homoglutamic acid and homocysteic acid
  MOD_RES (16)..(16): Xaa is Ser, Glu, Gln, homoglutamic acid or homocysteic acid
  MOD_RES (20)..(20): Xaa is Gln, Lys, Arg, Orn or Cit
  MOD_RES (21)..(21): Xaa is Gln, Glu, Asp, Cys, Orn, homocycstein or acetyl Phe
  MOD_RES (23)..(23): Xaa is Val or Ile
  MOD_RES (24)..(24): Xaa is Ala, Gln, Glu, Cys, Orn, homocycsteine or acetyl Phe
  MOD_RES (27)..(27): Xaa is Met, Leu or Nle
  MOD_RES (28)..(28): Xaa is Asn, Lys or Asp
  MOD_RES (29)..(29): Xaa is Thr, Gly, Lys, Cys, Orn, homocycsteine or acetyl Phe
XXXGTFTSDYSKYLXXRRAXXFXXWLXXX

SEQ ID NO: 457 - protein, 29 aa, Artificial Sequence
  Synthetic Glucagon Analogue
  MOD_RES (1)..(1): Xaa is His, D-His, (Des-amino)His, hydroxyl-His, acetyl- His, homo-His, DMIA, N-methyl His, alpha-methyl His, or imidazole acetic acid
  MOD_RES (2)..(2): Xaa is Ser, D-Ser, Ala, D-Ala, Val, Gly, N-methyl Ser, Aib or N-methyl Ala
  MOD_RES (3)..(3): Xaa is Gln, Glu, Orn or  Nle
  MISC_FEATURE (12)..(16): Lactam ring between side changes at position 12 and 16
  MOD_RES (15)..(15): Xaa is Asp, Glu, cysteic acid, homoglutamic acid and homocysteic acid
  MOD_RES (20)..(20): Xaa is Gln, Lys, Arg, Orn or Cit
  MOD_RES (21)..(21): Xaa is Gln, Glu, Asp, Cys, Orn, homocycsteine or acetyl Phe
  MOD_RES (23)..(23): Xaa is Val or Ile
  MOD_RES (24)..(24): Xaa is Ala, Gln, Glu, Lys, Cys, Orn, homocysteine or acetyl Phe
  MOD_RES (27)..(27): Xaa is Met, Leu or Nle
  MOD_RES (28)..(28): Xaa is Asn, Lys or Asp
  MOD_RES (29)..(29): Xaa is Thr, Gly, Lys, Cys, Orn, homocysteine or acetyl Phe
XXXGTFTSDYSKYLXERRAXXFXXWLXXX

SEQ ID NO: 458 - protein, 29 aa, Artificial Sequence
  Synthetic Glucagon Analogue
  MOD_RES (1)..(1): Xaa is His, D-His, (Des-amino)His, hydroxyl-His, acetyl-His, homo-His, DMIA, N-methyl His, alpha-methyl His, or imidazole acetic acid
  MOD_RES (2)..(2): Xaa is Ser, D-Ser, Ala, D-Ala, Val, Gly, N-methyl Ser, AIB or N-methyl Ala
  MOD_RES (3)..(3): Xaa is Gln, Glu, Orn or Nle
  MOD_RES (15)..(15): Xaa is Asp, Glu, cysteic acid, homoglutamic acid or homocysteic acid
  MISC_FEATURE (16)..(20): Lactam ring between side chains at positions 16 and 20
  MOD_RES (21)..(21): Xaa is Gln, Glu, Asp, Lys, Cys, Orn, homocysteine or acetyl Phe
  MOD_RES (23)..(23): Xaa is Val or Ile
  MOD_RES (24)..(24): Xaa is Ala, Gln, Glu, Lys, Cys, Orn, homocysteine or acetyl Phe
  MOD_RES (27)..(27): Xaa is Met, Leu or Nle
  MOD_RES (28)..(28): Xaa is Asn, Lys or Asp
  MOD_RES (29)..(29): Xaa is Thr, Gly, Lys, Cys, Orn, homocysteine or acetyl Phe
XXXGTFTSDYSKYLXERRAKXFXXWLXXX

SEQ ID NO: 459 - protein, 29 aa, Artificial Sequence
  Synthetic Glucagon Analogue
  MOD_RES (1)..(1): Xaa is His, D-His, (Des-amino)His, hydroxyl-His, acetyl-His, homo-His, DMIA, N-methyl His, alpha-methyl His, or imidazole acetic acid
  MOD_RES (2)..(2): Xaa is Ser, D-Ser, Ala, D-Ala, Val, Gly, N-methyl Ser, AIB, or N-methyl Ala
  MOD_RES (3)..(3): Xaa is Gln, Glu, Orn or  Nle
  MOD_RES (15)..(15): Xaa is Asp, Glu, cysteic acid, homoglutamic acid and homocysteic acid
  MOD_RES (16)..(16): Xaa is Ser, Glu, Gln, homoglutamic acid or homocysteic acid
  MISC_FEATURE (20)..(24): Lactam ring between side chains at position 20 and 24
  MOD_RES (21)..(21): Xaa is Gln, Glu, Asp, Lys, Cys, Orn, homocysteine or acetyl Phe
  MOD_RES (23)..(23): Xaa is Val or Ile
  MOD_RES (27)..(27): Xaa is Met, Leu or Nle
  MOD_RES (28)..(28): Xaa is Asn, Lys or Asp
  MOD_RES (29)..(29): Xaa is Thr, Gly, Lys, Cys, Orn, homocysteine or acetyl Phe
XXXGTFTSDYSKYLXXRRAKXFXEWLXXX

SEQ ID NO: 460 - protein, 29 aa, Artificial Sequence
  Synthetic Glucagon Analogue
  MOD_RES (1)..(1): Xaa is His, D-His, (Des-amino)His, hydroxyl-His, acetyl-His, homo-His, DMIA, N-methyl His, alpha-methyl His, or imidazole acetic acid
  MOD_RES (2)..(2): Xaa is Ser, D-Ser, Ala, D-Ala, Val, Gly, N-methyl Ser, AIB or N-methyl Ala
  MOD_RES (3)..(3): Xaa is Gln, Glu, Orn or  Nle
  MOD_RES (15)..(15): Xaa is Asp, Glu, cysteic acid, homoglutamic acid and homocysteic acid
  MOD_RES (16)..(16): Xaa is Ser, Glu, Gln, homoglutamic acid or homocysteic acid
  MOD_RES (20)..(20): Xaa is Gln, Lys, Arg, Orn, or Cit
  MOD_RES (21)..(21): Xaa is Gln, Glu, Asp, Lys, Cys, Orn, homocysteine or acetyl Phe
  MOD_RES (23)..(23): Xaa is Val or Ile
  MISC_FEATURE (24)..(28): Lactam ring between side chains at position 24 and 28
  MOD_RES (27)..(27): Xaa is Met, Leu or Nle
  MOD_RES (29)..(29): TXaa is hr, Gly, Lys, Cys, Orn, homocysteine or acetyl Phe
XXXGTFTSDYSKYLXXRRAXXFXEWLXKX

SEQ ID NO: 461 - protein, 40 aa, Artificial Sequence
  Synthetic Glucagon Analogue
  MISC_FEATURE (1)..(40): Positions 30 to 40 are present only if position 29 is Gly; see specification as filed for detailed description of substitutions and preferred embodiments
  MOD_RES (1)..(1): Xaa is His, D-His, (Des-amino)His, hydroxyl-His, acetyl-His, homo-His, DMIA, N-methyl His, alpha-methyl His, or imidazole acetic acid
  MOD_RES (2)..(2): Xaa is Ser, D-Ser, Ala, Val, Gly, N-methyl Ser, Aib, N-methyl, Ala or D-Ala
  MOD_RES (18)..(18): Xaa is Ala or Arg
  MOD_RES (24)..(24): Xaa is Ala, Gln or Cys-PEG
  MOD_RES (29)..(29): Xaa is Thr-CONH2, Cys-PEG, or Gly
  MOD_RES (40)..(40): Xaa is Cys-PEG or not present
  MOD_RES (40)..(40): Xaa is Cys-PEG or is not present
XXQGTFTSDYSKYLDERXAKDFVXWLMNXGPSSGAPPPSC

SEQ ID NO: 462 - protein, 40 aa, Artificial Sequence
  Synthetic Glucagon Analogue
  MISC_FEATURE (1)..(40): Positions 30 to 40 are present only if position 29 is Gly; see specification as filed for detailed description of substitutions and preferred embodiments
  MOD_RES (1)..(1): Xaa is His, D-His, (Des-amino)His, hydroxyl-His, acetyl-His, homo-His, DMIA, N-methyl His, alpha-methyl His, or imidazole acetic acid
  MOD_RES (2)..(2): Xaa is Ser, D-Ser, Ala, Val, Gly, N-methyl Ser, Aib, N-methyl Ala, or D-Ala
  MOD_RES (18)..(18): Xaa is Ala or Arg
  MOD_RES (24)..(24): Xaa is Ala, Gln or Cys-PEG
  MOD_RES (29)..(29): Xaa is Thr-CONH2, Cys-PEG, or Gly
  MOD_RES (40)..(40): Xaa is Cys-PEG or is not present
XXQGTFTSDYSKYLDEQXAKEFIXWLMNXGPSSGAPPPSC

SEQ ID NO: 463 - protein, 29 aa, Artificial Sequence
  Synthetic Glucagon Analogue
  MOD_RES (16)..(16): Xaa is Ser, Glu, Gln, homoglutamic acid or homocysteic acid
  MOD_RES (20)..(20): Xaa is Gln or Lys
  MOD_RES (21)..(21): Xaa is Asp, Lys, Cys, Orn, homocysteine or acetyl Phe
  MOD_RES (24)..(24): Xaa is Gln, Lys, Cys, Orn, homocysteine or acetyl Phe
  MOD_RES (27)..(27): Xaa is Met, Leu or Nle
HSQGTFTSDYSKYLDXRRAXXFVXWLXNT

SEQ ID NO: 464 - protein, 38 aa, Artificial Sequence
  Synthetic Glucagon Analogue
  MOD_RES (15)..(15): Xaa is Asp, Glu, homoglutamic acid, cysteic acid or homocysteic acid
  MOD_RES (16)..(16): Xaa is Ser, Glu, Gln, homoglutamic acid or homocysteic acid
  MOD_RES (20)..(20): Xaa is Gln or Lys
  MOD_RES (24)..(24): Xaa is Gln or Glu
  MOD_RES (28)..(28): Xaa is Asn, Lys or Asp
HSQGTFTSDYSKYLXXRRAXDFVXWLMXGGPSSGPPPS

SEQ ID NO: 465 - protein, 11 aa, Artificial Sequence
  Synthetic peptide fragment representing the carboxy terminal 10 amino acids of Exdendin-4
  MOD_RES (11)..(11): Bound to PEG
GPSSGAPPPSC

SEQ ID NO: 466 - protein, 29 aa, Artificial Sequence
  Synthetic Glucagon Analogue
  MISC_FEATURE (12)..(16): Lactam ring between side chains at positions 12 and 16
  MOD_RES (28)..(28): Xaa is Asp or Asn
  MOD_RES (29)..(29): Xaa is Thr or Gly
HSQGTFTSDYSKYLDERRAQDFVQWLMXX

SEQ ID NO: 467 - protein, 29 aa, Artificial Sequence
  Synthetic Glucagon Analogue
  MISC_FEATURE (16)..(20): Lactam ring between side chains at positions 16 and 20
  MOD_RES (28)..(28): Xaa is Asp or Asn
  MOD_RES (29)..(29): Xaa is Thr or Gly
HSQGTFTSDYSKYLDERRAKDFVQWLMXX

SEQ ID NO: 468 - protein, 29 aa, Artificial Sequence
  Synthetic Glucagon Analogue
  MISC_FEATURE (20)..(24): Lactam ring between side chains at positions 20 and 24
  MOD_RES (28)..(28): Xaa is Asp or Asn
  MOD_RES (29)..(29): Xaa is Thr or Gly
HSQGTFTSDYSKYLDSRRAKDFVEWLMXX

SEQ ID NO: 469 - protein, 29 aa, Artificial Sequence
  glucagon analogue
  MISC_FEATURE (24)..(28): Lactam ring between side chains at positions 24 and 28
  MOD_RES (29)..(29): Xaa is Thr or Gly
HSQGTFTSDYSKYLDSRRAQDFVEWLMKX

SEQ ID NO: 470 - protein, 29 aa, Artificial Sequence
  Synthetic peptide
  MOD_RES (29)..(29): AMIDATION
HSQGTFTSDYSKYLDERRAQDFVQWLMNT

SEQ ID NO: 471 - protein, 29 aa, Artificial Sequence
  Synthetic peptide
  MOD_RES (29)..(29): AMIDATION
HSQGTFTSDYSKYLDERRAKDFVQWLMNT

SEQ ID NO: 472 - protein, 29 aa, Artificial Sequence
  Synthetic peptide
  MISC_FEATURE (16)..(20): Lactam ring between side chains at positions 16 and 20
  MOD_RES (29)..(29): AMIDATION
HSQGTFTSDYSKYLDERRAKDFVQWLMNT

SEQ ID NO: 473 - protein, 29 aa, Artificial Sequence
  Synthetic peptide
  MISC_FEATURE (12)..(16): Lactam ring between side chains at positions 12 and 16
  MOD_RES (29)..(29): AMIDATION
HSQGTFTSDYSKYLDERRAQDFVQWLMNT

SEQ ID NO: 474 - protein, 29 aa, Artificial Sequence
  Synthetic peptide
  MISC_FEATURE (12)..(16): Lactam ring between side chains at positions 12 and 16
  MOD_RES (29)..(29): AMIDATION
HSQGTFTSDYSKYLDERRAKDFVQWLMNT

SEQ ID NO: 475 - protein, 29 aa, Artificial Sequence
  Synthetic peptide
  MISC_FEATURE (16)..(20): Lactam ring between side chains at positions 16 and 20
  MOD_RES (29)..(29): AMIDATION
HSQGTFTSDYSKYLDKRRAEDFVQWLMNT

SEQ ID NO: 476 - protein, 29 aa, Artificial Sequence
  Synthetic peptide
  MOD_RES (29)..(29): AMIDATION
HSQGTFTSDYSKYLDERAAKDFVQWLMNT

SEQ ID NO: 477 - protein, 29 aa, Artificial Sequence
  Synthetic Polypeptide
  MISC_FEATURE (16)..(20): Lactam ring between side chains at positions 16 and 20
  MOD_RES (29)..(29): AMIDATION
HSQGTFTSDYSKYLDERAAKDFVQWLMNT

SEQ ID NO: 478 - protein, 29 aa, Artificial Sequence
  Synthetic Polypeptide
  MISC_FEATURE (12)..(16): Lactam ring between side chains at positions 12 and 16
  MOD_RES (29)..(29): AMIDATION
HSQGTFTSDYSKYLDERAAQDFVQWLMNT

SEQ ID NO: 479 - protein, 29 aa, Artificial Sequence
  Synthetic Polypeptide
  MISC_FEATURE (12)..(16): Lactam ring between side chains at positions 12 and 16
  MOD_RES (29)..(29): AMIDATION
HSQGTFTSDYSKYLDERAAKDFVQWLMNT

SEQ ID NO: 480 - protein, 29 aa, Artificial Sequence
  Synthetic Polypeptide
  MISC_FEATURE (16)..(20): Lactam ring between side chains at positions 16 and 20
  MOD_RES (29)..(29): AMIDATION
HSQGTFTSDYSKYLDKRAAEDFVQWLMNT

SEQ ID NO: 481 - protein, 29 aa, Artificial Sequence
  Synthetic Polypeptide
  MOD_RES (29)..(29): AMIDATION
HSQGTFTSDYSKYLDEQAAKEFIAWLMNT

SEQ ID NO: 482 - protein, 29 aa, Artificial Sequence
  Synthetic Polypeptide
  MISC_FEATURE (12)..(16): Lactam ring between side chains at positions 12 and 16
  MOD_RES (29)..(29): AMIDATION
HSQGTFTSDYSKYLDEQAAKEFIAWLMNT

SEQ ID NO: 483 - protein, 29 aa, Artificial Sequence
  Synthetic Polypeptide
  MISC_FEATURE (16)..(20): Lactam ring between side chains at positions 16 and 20
  MOD_RES (29)..(29): AMIDATION
HSQGTFTSDYSKYLDEQAAKEFIAWLMNT

SEQ ID NO: 484 - protein, 29 aa, Artificial Sequence
  Synthetic Polypeptide
  MOD_RES (29)..(29): AMIDATION
HSQGTFTSDYSKYLDEQAAKEFIAWLVKG

SEQ ID NO: 485 - protein, 29 aa, Artificial Sequence
  Synthetic Polypeptide
  MISC_FEATURE (12)..(16): Lactam ring between side chains at positions 12 and 16
  MOD_RES (29)..(29): AMIDATION
HSQGTFTSDYSKYLDEQAAKEFIAWLVKG

SEQ ID NO: 486 - protein, 29 aa, Artificial Sequence
  Synthetic Polypeptide
  MISC_FEATURE (16)..(20): Lactam ring between side chains at positions 16 and 20
  MOD_RES (29)..(29): AMIDATION
HSQGTFTSDYSKYLDEQAAKEFIAWLVKG

SEQ ID NO: 487 - protein, 29 aa, Artificial Sequence
  Synthetic Polypeptide
  MOD_RES (1)..(1): Xaa is (Des-amino)His
  MOD_RES (29)..(29): AMIDATION
XSQGTFTSDYSKYLDERRAQDFVQWLMNT

SEQ ID NO: 488 - protein, 29 aa, Artificial Sequence
  Synthetic Polypeptide
  MOD_RES (1)..(1): Xaa is (Des-amino)His
  MOD_RES (29)..(29): AMIDATION
XSQGTFTSDYSKYLDERRAKDFVQWLMNT

SEQ ID NO: 489 - protein, 29 aa, Artificial Sequence
  Synthetic Polypeptide
  MOD_RES (1)..(1): Xaa is (Des-amino)His
  MISC_FEATURE (16)..(20): Lactam ring between side chains at positions 16 and 20
  MOD_RES (29)..(29): AMIDATION
XSQGTFTSDYSKYLDERRAKDFVQWLMNT

SEQ ID NO: 490 - protein, 29 aa, Artificial Sequence
  Synthetic Polypeptide
  MOD_RES (1)..(1): Xaa is (Des-amino)His
  MISC_FEATURE (12)..(16): Lactam ring between side chains at positions 12 and 16
  MOD_RES (29)..(29): AMIDATION
XSQGTFTSDYSKYLDERRAQDFVQWLMNT

SEQ ID NO: 491 - protein, 29 aa, Artificial Sequence
  Synthetic Polypeptide
  MOD_RES (1)..(1): Xaa is (Des-amino)His
  MISC_FEATURE (12)..(16): Lactam ring between side chains at positions 12 and 16
  MOD_RES (29)..(29): AMIDATION
XSQGTFTSDYSKYLDERRAKDFVQWLMNT

SEQ ID NO: 492 - protein, 29 aa, Artificial Sequence
  Synthetic Polypeptide
  MOD_RES (1)..(1): Xaa is (Des-amino)His
  MISC_FEATURE (16)..(20): Lactam ring between side chains at positions 16 and 20
  MOD_RES (29)..(29): AMIDATION
XSQGTFTSDYSKYLDKRRAEDFVQWLMNT

SEQ ID NO: 493 - protein, 29 aa, Artificial Sequence
  Synthetic Polypeptide
  MOD_RES (1)..(1): Xaa is (Des-amino)His
  MOD_RES (29)..(29): AMIDATION
XSQGTFTSDYSKYLDERAAKDFVQWLMNT

SEQ ID NO: 494 - protein, 29 aa, Artificial Sequence
  Synthetic Polypeptide
  MOD_RES (1)..(1): Xaa is (Des-amino)His
  MISC_FEATURE (16)..(20): Lactam ring between side chains at positions 16 and 20
  MOD_RES (29)..(29): AMIDATION
XSQGTFTSDYSKYLDERAAKDFVQWLMNT

SEQ ID NO: 495 - protein, 29 aa, Artificial Sequence
  Synthetic Polypeptide
  MOD_RES (1)..(1): Xaa is (Des-amino)His
  MISC_FEATURE (12)..(16): Lactam ring between side chains at positions 12 and 16
  MOD_RES (29)..(29): AMIDATION
XSQGTFTSDYSKYLDERAAQDFVQWLMNT

SEQ ID NO: 496 - protein, 29 aa, Artificial Sequence
  Synthetic Polypeptide
  MOD_RES (1)..(1): Xaa is (Des-amino)His
  MISC_FEATURE (12)..(16): Lactam ring between side chains at positions 12 and 16
  MOD_RES (29)..(29): AMIDATION
XSQGTFTSDYSKYLDERAAKDFVQWLMNT

SEQ ID NO: 497 - protein, 29 aa, Artificial Sequence
  Synthetic Polypeptide
  MOD_RES (1)..(1): Xaa is (Des-amino)His
  MISC_FEATURE (16)..(20): Lactam ring between side chains at positions 16 and 20
  MOD_RES (29)..(29): AMIDATION
XSQGTFTSDYSKYLDKRAAEDFVQWLMNT

SEQ ID NO: 498 - protein, 29 aa, Artificial Sequence
  Synthetic Polypeptide
  MOD_RES (1)..(1): (Des-amino)His
  MISC_FEATURE (12)..(16): Lactam ring between side chains at positions 12 and 16
  MOD_RES (29)..(29): AMIDATION
XSQGTFTSDYSKYLDEQAAKEFIAWLMNT

SEQ ID NO: 499 - protein, 29 aa, Artificial Sequence
  Synthetic Polypeptide
  MOD_RES (1)..(1): Xaa is (Des-amino)His
  MISC_FEATURE (12)..(16): Lactam ring between side chains at positions 12 and 16
  MOD_RES (29)..(29): AMIDATION
XSQGTFTSDYSKYLDEQAAKEFIAWLMNT

SEQ ID NO: 500 - protein, 29 aa, Artificial Sequence
  Synthetic Polypeptide
  MOD_RES (1)..(1): Xaa is (Des-amino)His
  MISC_FEATURE (16)..(20): Lactam ring between side chains at positions 16 and 20
  MOD_RES (29)..(29): AMIDATION
XSQGTFTSDYSKYLDEQAAKEFIAWLMNT

SEQ ID NO: 501 - protein, 29 aa, Artificial Sequence
  Synthetic Polypeptide
  MOD_RES (1)..(1): Xaa is (Des-amino)His
  MOD_RES (29)..(29): AMIDATION
XSQGTFTSDYSKYLDEQAAKEFIAWLVKG

SEQ ID NO: 502 - protein, 29 aa, Artificial Sequence
  Synthetic Polypeptide
  MOD_RES (1)..(1): Xaa is (Des-amino)His
  MISC_FEATURE (12)..(16): Lactam ring between side chains at positions 12 and 16
  MOD_RES (29)..(29): AMIDATION
XSQGTFTSDYSKYLDEQAAKEFIAWLVKG

SEQ ID NO: 503 - protein, 29 aa, Artificial Sequence
  Synthetic Polypeptide
  MOD_RES (1)..(1): Xaa is (Des-amino)His
  MISC_FEATURE (16)..(20): Lactam ring between side chains at positions 16 and 20
  MOD_RES (29)..(29): AMIDATION
XSQGTFTSDYSKYLDEQAAKEFIAWLVKG

SEQ ID NO: 504 - protein, 29 aa, Artificial Sequence
  Synthetic Polypeptide
  MOD_RES (2)..(2): Xaa is Aib
  MOD_RES (29)..(29): AMIDATION
HXQGTFTSDYSKYLDERRAQDFVQWLMNT

SEQ ID NO: 505 - protein, 29 aa, Artificial Sequence
  Synthetic Polypeptide
  MOD_RES (2)..(2): Xaa is Aib
  MISC_FEATURE (16)..(20): Lactam ring between side chains at positions 16 and 20
  MOD_RES (29)..(29): AMIDATION
HXQGTFTSDYSKYLDERRAKDFVQWLMNT

SEQ ID NO: 506 - protein, 29 aa, Artificial Sequence
  Synthetic Polypeptide
  MOD_RES (2)..(2): Xaa is Aib
  MISC_FEATURE (16)..(20): Lactam ring between side chains at positions 16 and 20
  MOD_RES (29)..(29): AMIDATION
HXQGTFTSDYSKYLDERRAKDFVQWLMNT

SEQ ID NO: 507 - protein, 29 aa, Artificial Sequence
  Synthetic Polypeptide
  MOD_RES (2)..(2): Xaa is Aib
  MISC_FEATURE (12)..(16): Lactam ring between side chains at positions 12 and 16
  MOD_RES (29)..(29): AMIDATION
HXQGTFTSDYSKYLDERRAQDFVQWLMNT

SEQ ID NO: 508 - protein, 29 aa, Artificial Sequence
  Synthetic Polypeptide
  MOD_RES (2)..(2): Xaa is Aib
  MISC_FEATURE (12)..(16): Lactam ring between side chains at positions 12 and 16
  MOD_RES (29)..(29): AMIDATION
HXQGTFTSDYSKYLDERRAKDFVQWLMNT

SEQ ID NO: 509 - protein, 29 aa, Artificial Sequence
  Synthetic Polypeptide
  MOD_RES (2)..(2): Xaa is Aib
  MISC_FEATURE (16)..(20): Lactam ring between side chains at positions 16 and 20
  MOD_RES (29)..(29): AMIDATION
HXQGTFTSDYSKYLDKRRAEDFVQWLMNT

SEQ ID NO: 510 - protein, 29 aa, Artificial Sequence
  Synthetic Polypeptide
  MOD_RES (2)..(2): Xaa is Aib
  MOD_RES (29)..(29): AMIDATION
HXQGTFTSDYSKYLDERAAKDFVQWLMNT

SEQ ID NO: 511 - protein, 29 aa, Artificial Sequence
  Synthetic Polypeptide
  MOD_RES (2)..(2): Xaa is Aib
  MISC_FEATURE (16)..(20): Lactam ring between side chains at positions 16 and 20
  MOD_RES (29)..(29): AMIDATION
HXQGTFTSDYSKYLDERAAKDFVQWLMNT

SEQ ID NO: 512 - protein, 29 aa, Artificial Sequence
  Synthetic Polypeptide
  MOD_RES (2)..(2): Xaa is Aib
  MISC_FEATURE (12)..(16): Lactam ring between side chains at positions 12 and 16
  MOD_RES (29)..(29): AMIDATION
HXQGTFTSDYSKYLDERAAQDFVQWLMNT

SEQ ID NO: 513 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXQGTFTSDYSKYLDERAAKDFVQWLMNT

SEQ ID NO: 514 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXQGTFTSDYSKYLDKRAAEDFVQWLMNT

SEQ ID NO: 515 - protein, 29 aa, Artificial Sequence
  glucagon analog
  MOD_RES (2)..(2): Xaa is Aib
  MOD_RES (29)..(29): AMIDATION
HXQGTFTSDYSKYLDEQAAKEFIAWLMNT

SEQ ID NO: 516 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXQGTFTSDYSKYLDEQAAKEFIAWLMNT

SEQ ID NO: 517 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXQGTFTSDYSKYLDEQAAKEFIAWLMNT

SEQ ID NO: 518 - protein, 29 aa, Artificial Sequence
  glucagon analog
  MOD_RES (2)..(2): Xaa is Aib
  MOD_RES (29)..(29): AMIDATION
HXQGTFTSDYSKYLDEQAAKEFIAWLVKG

SEQ ID NO: 519 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXQGTFTSDYSKYLDEQAAKEFIAWLVKG

SEQ ID NO: 520 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXQGTFTSDYSKYLDEQAAKEFIAWLVKG

SEQ ID NO: 521 - protein, 29 aa, Artificial Sequence
  glucagon analog
  MOD_RES (2)..(2): Xaa is D-Ala
  MOD_RES (29)..(29): AMIDATION
HXQGTFTSDYSKYLDERRAQDFVQWLMNT

SEQ ID NO: 522 - protein, 29 aa, Artificial Sequence
  glucagon analog
  MOD_RES (2)..(2): Xaa is D-Ala
  MOD_RES (29)..(29): AMIDATION
HXQGTFTSDYSKYLDERRAKDFVQWLMNT

SEQ ID NO: 523 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXQGTFTSDYSKYLDERRAKDFVQWLMNT

SEQ ID NO: 524 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXQGTFTSDYSKYLDERRAQDFVQWLMNT

SEQ ID NO: 525 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXQGTFTSDYSKYLDERRAKDFVQWLMNT

SEQ ID NO: 526 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXQGTFTSDYSKYLDKRRAEDFVQWLMNT

SEQ ID NO: 527 - protein, 29 aa, Artificial Sequence
  glucagon analog
  MOD_RES (2)..(2): Xaa is D-Ala
  MOD_RES (29)..(29): AMIDATION
HXQGTFTSDYSKYLDERAAKDFVQWLMNT

SEQ ID NO: 528 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXQGTFTSDYSKYLDERAAKDFVQWLMNT

SEQ ID NO: 529 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXQGTFTSDYSKYLDERAAQDFVQWLMNT

SEQ ID NO: 530 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXQGTFTSDYSKYLDERAAKDFVQWLMNT

SEQ ID NO: 531 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXQGTFTSDYSKYLDKRAAEDFVQWLMNT

SEQ ID NO: 532 - protein, 29 aa, Artificial Sequence
  glucagon analog
  MOD_RES (2)..(2): Xaa is D-Ala
  MOD_RES (29)..(29): AMIDATION
HXQGTFTSDYSKYLDEQAAKEFIAWLMNT

SEQ ID NO: 533 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXQGTFTSDYSKYLDEQAAKEFIAWLMNT

SEQ ID NO: 534 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXQGTFTSDYSKYLDEQAAKEFIAWLMNT

SEQ ID NO: 535 - protein, 29 aa, Artificial Sequence
  glucagon analog
  MOD_RES (2)..(2): Xaa is D-Ala
  MOD_RES (29)..(29): AMIDATION
HXQGTFTSDYSKYLDEQAAKEFIAWLVKG

SEQ ID NO: 536 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXQGTFTSDYSKYLDEQAAKEFIAWLVKG

SEQ ID NO: 537 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXQGTFTSDYSKYLDEQAAKEFIAWLVKG

SEQ ID NO: 538 - protein, 29 aa, Artificial Sequence
  glucagon analog
  MOD_RES (29)..(29): AMIDATION
HSEGTFTSDYSKYLDERRAQDFVQWLMNT

SEQ ID NO: 539 - protein, 29 aa, Artificial Sequence
  glucagon analog
  MOD_RES (29)..(29): AMIDATION
HSEGTFTSDYSKYLDERRAKDFVQWLMNT

SEQ ID NO: 540 - protein, 29 aa, Artificial Sequence
  glucagon analog
  MISC_FEATURE (16)..(20): Lactam ring between side chains at positions 16 and 20
  MOD_RES (29)..(29): AMIDATION
HSEGTFTSDYSKYLDERRAKDFVQWLMNT

SEQ ID NO: 541 - protein, 29 aa, Artificial Sequence
  glucagon analog
  MISC_FEATURE (12)..(16): Lactam ring between side chains at positions 12 and 16
  MOD_RES (29)..(29): AMIDATION
HSEGTFTSDYSKYLDERRAQDFVQWLMNT

SEQ ID NO: 542 - protein, 29 aa, Artificial Sequence
  glucagon analog
  MISC_FEATURE (12)..(16): Lactam ring between side chains at positions 12 and 16
  MOD_RES (29)..(29): AMIDATION
HSEGTFTSDYSKYLDERRAKDFVQWLMNT

SEQ ID NO: 543 - protein, 29 aa, Artificial Sequence
  glucagon analog
  MISC_FEATURE (16)..(20): Lactam ring between side chains at positions 16 and 20
  MOD_RES (29)..(29): AMIDATION
HSEGTFTSDYSKYLDKRRAEDFVQWLMNT

SEQ ID NO: 544 - protein, 29 aa, Artificial Sequence
  glucagon analog
  MOD_RES (29)..(29): AMIDATION
HSEGTFTSDYSKYLDERAAKDFVQWLMNT

SEQ ID NO: 545 - protein, 29 aa, Artificial Sequence
  glucagon analog
  MISC_FEATURE (16)..(20): Lactam ring between side chains at positions 16 and 20
  MOD_RES (29)..(29): AMIDATION
HSEGTFTSDYSKYLDERAAKDFVQWLMNT

SEQ ID NO: 546 - protein, 29 aa, Artificial Sequence
  glucagon analog
  MISC_FEATURE (12)..(16): Lactam ring between side chains at positions 12 and 16
  MOD_RES (29)..(29): AMIDATION
HSEGTFTSDYSKYLDERAAQDFVQWLMNT

SEQ ID NO: 547 - protein, 29 aa, Artificial Sequence
  glucagon analog
  MISC_FEATURE (12)..(16): Lactam ring between side chains at positions 12 and 16
  MOD_RES (29)..(29): AMIDATION
HSEGTFTSDYSKYLDERAAKDFVQWLMNT

SEQ ID NO: 548 - protein, 29 aa, Artificial Sequence
  glucagon analog
  MISC_FEATURE (16)..(20): Lactam ring between side chains at positions 16 and 20
  MOD_RES (29)..(29): AMIDATION
HSEGTFTSDYSKYLDKRAAEDFVQWLMNT

SEQ ID NO: 549 - protein, 29 aa, Artificial Sequence
  glucagon analog
  MOD_RES (29)..(29): AMIDATION
HSEGTFTSDYSKYLDEQAAKEFIAWLMNT

SEQ ID NO: 550 - protein, 29 aa, Artificial Sequence
  glucagon analog
  MISC_FEATURE (12)..(16): Lactam ring between side chains at positions 12 and 16
  MOD_RES (29)..(29): AMIDATION
HSEGTFTSDYSKYLDEQAAKEFIAWLMNT

SEQ ID NO: 551 - protein, 29 aa, Artificial Sequence
  glucagon analog
  MISC_FEATURE (16)..(20): Lactam ring between side chains at positions 16 and 20
  MOD_RES (29)..(29): AMIDATION
HSEGTFTSDYSKYLDEQAAKEFIAWLMNT

SEQ ID NO: 552 - protein, 29 aa, Artificial Sequence
  glucagon analog
  MOD_RES (29)..(29): AMIDATION
HSEGTFTSDYSKYLDEQAAKEFIAWLVKG

SEQ ID NO: 553 - protein, 29 aa, Artificial Sequence
  glucagon analog
  MISC_FEATURE (12)..(16): Lactam ring between side chains at positions 12 and 16
  MOD_RES (29)..(29): AMIDATION
HSEGTFTSDYSKYLDEQAAKEFIAWLVKG

SEQ ID NO: 554 - protein, 29 aa, Artificial Sequence
  glucagon analog
  MISC_FEATURE (16)..(20): Lactam ring between side chains at positions 16 and 20
  MOD_RES (29)..(29): AMIDATION
HSEGTFTSDYSKYLDEQAAKEFIAWLVKG

SEQ ID NO: 555 - protein, 29 aa, Artificial Sequence
  glucagon analog
  MOD_RES (1)..(1): Xaa is (Des-amino)His
  MOD_RES (29)..(29): AMIDATION
XSEGTFTSDYSKYLDERRAQDFVQWLMNT

SEQ ID NO: 556 - protein, 29 aa, Artificial Sequence
  glucagon analog
  MOD_RES (1)..(1): Xaa is (Des-amino)His
  MOD_RES (29)..(29): AMIDATION
XSEGTFTSDYSKYLDERRAKDFVQWLMNT

SEQ ID NO: 557 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (29)..(29): AMIDATION
XSEGTFTSDYSKYLDERRAKDFVQWLMNT

SEQ ID NO: 558 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (29)..(29): AMIDATION
XSEGTFTSDYSKYLDERRAQDFVQWLMNT

SEQ ID NO: 559 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (29)..(29): AMIDATION
XSEGTFTSDYSKYLDERRAKDFVQWLMNT

SEQ ID NO: 560 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (29)..(29): AMIDATION
XSEGTFTSDYSKYLDKRRAEDFVQWLMNT

SEQ ID NO: 561 - protein, 29 aa, Artificial Sequence
  glucagon analog
  MOD_RES (1)..(1): Xaa is (Des-amino)His
  MOD_RES (29)..(29): AMIDATION
XSEGTFTSDYSKYLDERAAKDFVQWLMNT

SEQ ID NO: 562 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (29)..(29): AMIDATION
XSEGTFTSDYSKYLDERAAKDFVQWLMNT

SEQ ID NO: 563 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (29)..(29): AMIDATION
XSEGTFTSDYSKYLDERAAQDFVQWLMNT

SEQ ID NO: 564 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (29)..(29): AMIDATION
XSEGTFTSDYSKYLDERAAKDFVQWLMNT

SEQ ID NO: 565 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (29)..(29): AMIDATION
XSEGTFTSDYSKYLDKRAAEDFVQWLMNT

SEQ ID NO: 566 - protein, 29 aa, Artificial Sequence
  glucagon analog
  MOD_RES (1)..(1): Xaa is (Des-amino)His
  MOD_RES (29)..(29): AMIDATION
XSEGTFTSDYSKYLDEQAAKEFIAWLMNT

SEQ ID NO: 567 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (29)..(29): AMIDATION
XSEGTFTSDYSKYLDEQAAKEFIAWLMNT

SEQ ID NO: 568 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (29)..(29): AMIDATION
XSEGTFTSDYSKYLDEQAAKEFIAWLMNT

SEQ ID NO: 569 - protein, 29 aa, Artificial Sequence
  glucagon analog
  MOD_RES (1)..(1): Xaa is (Des-amino)His
  MOD_RES (29)..(29): AMIDATION
XSEGTFTSDYSKYLDEQAAKEFIAWLVKG

SEQ ID NO: 570 - protein, 29 aa, Artificial Sequence
  glucagon analog
  MOD_RES (1)..(1): Xaa is (Des-amino)His
  MISC_FEATURE (12)..(16): Lactam ring between side chains at positions 12 and 16
  MOD_RES (29)..(29): AMIDATION
XSEGTFTSDYSKYLDEQAAKEFIAWLVKG

SEQ ID NO: 571 - protein, 29 aa, Artificial Sequence
  glucagon analog
  MOD_RES (1)..(1): Xaa is (Des-amino)His
  MISC_FEATURE (16)..(20): Lactam ring between side chains at positions 16 and 20
  MOD_RES (29)..(29): AMIDATION
XSEGTFTSDYSKYLDEQAAKEFIAWLVKG

SEQ ID NO: 572 - protein, 29 aa, Artificial Sequence
  glucagon analog
  MOD_RES (2)..(2): Xaa is Aib
  MOD_RES (29)..(29): AMIDATION
HXEGTFTSDYSKYLDERRAQDFVQWLMNT

SEQ ID NO: 573 - protein, 29 aa, Artificial Sequence
  glucagon analog
  MOD_RES (2)..(2): Xaa is Aib
  MOD_RES (29)..(29): AMIDATION
HXEGTFTSDYSKYLDERRAKDFVQWLMNT

SEQ ID NO: 574 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXEGTFTSDYSKYLDERRAKDFVQWLMNT

SEQ ID NO: 575 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXEGTFTSDYSKYLDERRAQDFVQWLMNT

SEQ ID NO: 576 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXEGTFTSDYSKYLDERRAKDFVQWLMNT

SEQ ID NO: 577 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXEGTFTSDYSKYLDKRRAEDFVQWLMNT

SEQ ID NO: 578 - protein, 29 aa, Artificial Sequence
  glucagon analog
  MOD_RES (2)..(2): Xaa is Aib
  MOD_RES (29)..(29): AMIDATION
HXEGTFTSDYSKYLDERAAKDFVQWLMNT

SEQ ID NO: 579 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXEGTFTSDYSKYLDERAAKDFVQWLMNT

SEQ ID NO: 580 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXEGTFTSDYSKYLDERAAQDFVQWLMNT

SEQ ID NO: 581 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXEGTFTSDYSKYLDERAAKDFVQWLMNT

SEQ ID NO: 582 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXEGTFTSDYSKYLDKRAAEDFVQWLMNT

SEQ ID NO: 583 - protein, 29 aa, Artificial Sequence
  glucagon analog
  MOD_RES (2)..(2): Xaa is Aib
  MOD_RES (29)..(29): AMIDATION
HXEGTFTSDYSKYLDEQAAKEFIAWLMNT

SEQ ID NO: 584 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXEGTFTSDYSKYLDEQAAKEFIAWLMNT

SEQ ID NO: 585 - protein, 29 aa, Artificial Sequence
  glucagon analog
  MOD_RES (2)..(2): Xaa is Aib
  MISC_FEATURE (16)..(20): Lactam ring between side chains at positions 16 and 20
  MOD_RES (29)..(29): AMIDATION
HXEGTFTSDYSKYLDEQAAKEFIAWLMNT

SEQ ID NO: 586 - protein, 29 aa, Artificial Sequence
  glucagon analog
  MOD_RES (2)..(2): Xaa is Aib
  MOD_RES (29)..(29): AMIDATION
HXEGTFTSDYSKYLDEQAAKEFIAWLVKG

SEQ ID NO: 587 - protein, 29 aa, Artificial Sequence
  glucagon analog
  MOD_RES (2)..(2): Xaa is Aib
  MISC_FEATURE (12)..(16): Lactam ring between side chains at positions 12 and 16
  MOD_RES (29)..(29): AMIDATION
HXEGTFTSDYSKYLDEQAAKEFIAWLVKG

SEQ ID NO: 588 - protein, 29 aa, Artificial Sequence
  glucagon analog
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXEGTFTSDYSKYLDEQAAKEFIAWLVKG

SEQ ID NO: 589 - protein, 29 aa, Artificial Sequence
  glucagon analog
  MOD_RES (2)..(2): Xaa is D-Ala
  MOD_RES (29)..(29): AMIDATION
HXEGTFTSDYSKYLDERRAQDFVQWLMNT

SEQ ID NO: 590 - protein, 29 aa, Artificial Sequence
  glucagon analog
  MOD_RES (2)..(2): Xaa is D-Ala
  MOD_RES (29)..(29): AMIDATION
HXEGTFTSDYSKYLDERRAKDFVQWLMNT

SEQ ID NO: 591 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXEGTFTSDYSKYLDERRAKDFVQWLMNT

SEQ ID NO: 592 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXEGTFTSDYSKYLDERRAQDFVQWLMNT

SEQ ID NO: 593 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXEGTFTSDYSKYLDERRAKDFVQWLMNT

SEQ ID NO: 594 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXEGTFTSDYSKYLDKRRAEDFVQWLMNT

SEQ ID NO: 595 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXEGTFTSDYSKYLDERAAKDFVQWLMNT

SEQ ID NO: 596 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXEGTFTSDYSKYLDERAAKDFVQWLMNT

SEQ ID NO: 597 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXEGTFTSDYSKYLDERAAQDFVQWLMNT

SEQ ID NO: 598 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXEGTFTSDYSKYLDERAAKDFVQWLMNT

SEQ ID NO: 599 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXEGTFTSDYSKYLDKRAAEDFVQWLMNT

SEQ ID NO: 600 - protein, 29 aa, Artificial Sequence
  glucagon analog
  MOD_RES (2)..(2): Xaa is D-Ala
  MOD_RES (29)..(29): AMIDATION
HXEGTFTSDYSKYLDEQAAKEFIAWLMNT

SEQ ID NO: 601 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXEGTFTSDYSKYLDEQAAKEFIAWLMNT

SEQ ID NO: 602 - protein, 29 aa, Artificial Sequence
  glucagon analog
  MOD_RES (2)..(2): Xaa is D-Ala
  MISC_FEATURE (16)..(20): Lactam ring between side chains at positions 16 and 20
  MOD_RES (29)..(29): AMIDATION
HXEGTFTSDYSKYLDEQAAKEFIAWLMNT

SEQ ID NO: 603 - protein, 29 aa, Artificial Sequence
  glucagon analog
  MOD_RES (2)..(2): Xaa is D-Ala
  MOD_RES (29)..(29): AMIDATION
HXEGTFTSDYSKYLDEQAAKEFIAWLVKG

SEQ ID NO: 604 - protein, 29 aa, Artificial Sequence
  glucagon analog
  MOD_RES (2)..(2): Xaa is D-Ala
  MISC_FEATURE (12)..(16): Lactam ring between side chains at positions 12 and 16
  MOD_RES (29)..(29): AMIDATION
HXEGTFTSDYSKYLDEQAAKEFIAWLVKG

SEQ ID NO: 605 - protein, 29 aa, Artificial Sequence
  glucagon analog
  MOD_RES (2)..(2): Xaa is D-Ala
  MISC_FEATURE (29)..(29): c-term amidation
  MOD_RES (29)..(29): AMIDATION
HXEGTFTSDYSKYLDEQAAKEFIAWLVKG

SEQ ID NO: 606 - protein, 29 aa, Artificial Sequence
  glucagon analog
  MOD_RES (24)..(24): Bound to PEG
  MOD_RES (29)..(29): AMIDATION
HSQGTFTSDYSKYLDERRAQDFVCWLMNT

SEQ ID NO: 607 - protein, 29 aa, Artificial Sequence
  glucagon analog
  MOD_RES (24)..(24): Bound to PEG
  MOD_RES (29)..(29): AMIDATION
HSQGTFTSDYSKYLDERRAKDFVCWLMNT

SEQ ID NO: 608 - protein, 29 aa, Artificial Sequence
  glucagon analog
  MISC_FEATURE (16)..(20): Lactam ring between side chains at positions 16 and 20
  MOD_RES (24)..(24): Bound to PEG
  MOD_RES (29)..(29): AMIDATION
HSQGTFTSDYSKYLDERRAKDFVCWLMNT

SEQ ID NO: 609 - protein, 29 aa, Artificial Sequence
  glucagon analog
  MISC_FEATURE (12)..(16): Lactam ring between side chains at positions 12 and 16
  MOD_RES (24)..(24): Bound to PEG
  MOD_RES (29)..(29): AMIDATION
HSQGTFTSDYSKYLDERRAQDFVCWLMNT

SEQ ID NO: 610 - protein, 29 aa, Artificial Sequence
  glucagon analog
  MISC_FEATURE (12)..(16): Lactam ring between side chains at positions 12 and 16
  MOD_RES (24)..(24): Bound to PEG
  MOD_RES (29)..(29): AMIDATION
HSQGTFTSDYSKYLDERRAKDFVCWLMNT

SEQ ID NO: 611 - protein, 29 aa, Artificial Sequence
  glucagon analog
  MISC_FEATURE (16)..(20): Lactam ring between side chains at positions 16 and 20
  MOD_RES (24)..(24): Bound to PEG
  MOD_RES (29)..(29): AMIDATION
HSQGTFTSDYSKYLDKRRAEDFVCWLMNT

SEQ ID NO: 612 - protein, 29 aa, Artificial Sequence
  glucagon analog
  MISC_FEATURE (16)..(20): Lactam ring between side chains at positions 16 and 20
  MOD_RES (24)..(24): Bound to PEG
  MOD_RES (29)..(29): AMIDATION
HSQGTFTSDYSKYLDERAAKDFVCWLMNT

SEQ ID NO: 613 - protein, 29 aa, Artificial Sequence
  glucagon analog
  MISC_FEATURE (16)..(20): Lactam ring between side chains at positions 16 and 20
  MOD_RES (24)..(24): Bound to PEG
  MOD_RES (29)..(29): AMIDATION
HSQGTFTSDYSKYLDERAAKDFVCWLMNT

SEQ ID NO: 614 - protein, 29 aa, Artificial Sequence
  glucagon analog
  MISC_FEATURE (12)..(16): Lactam ring between side chains at positions 12 and 16
  MOD_RES (24)..(24): Bound to PEG
  MOD_RES (29)..(29): AMIDATION
HSQGTFTSDYSKYLDERAAQDFVCWLMNT

SEQ ID NO: 615 - protein, 29 aa, Artificial Sequence
  glucagon analog
  MISC_FEATURE (12)..(16): Lactam ring between side chains at positions 12 and 16
  MOD_RES (24)..(24): Bound to PEG
  MOD_RES (29)..(29): AMIDATION
HSQGTFTSDYSKYLDERAAKDFVCWLMNT

SEQ ID NO: 616 - protein, 29 aa, Artificial Sequence
  glucagon analog
  MISC_FEATURE (16)..(20): Lactam ring between side chains at positions 16 and 20
  MOD_RES (24)..(24): Bound to PEG
  MOD_RES (29)..(29): AMIDATION
HSQGTFTSDYSKYLDKRAAEDFVCWLMNT

SEQ ID NO: 617 - protein, 29 aa, Artificial Sequence
  glucagon analog
  MOD_RES (24)..(24): Bound to PEG
  MOD_RES (29)..(29): AMIDATION
HSQGTFTSDYSKYLDEQAAKEFICWLMNT

SEQ ID NO: 618 - protein, 29 aa, Artificial Sequence
  glucagon analog
  MISC_FEATURE (12)..(16): Lactam ring between side chains at positions 12 and 16
  MOD_RES (24)..(24): Bound to PEG
  MOD_RES (29)..(29): AMIDATION
HSQGTFTSDYSKYLDEQAAKEFICWLMNT

SEQ ID NO: 619 - protein, 29 aa, Artificial Sequence
  glucagon analog
  MISC_FEATURE (16)..(20): Lactam ring between side chains at positions 16 and 20
  MOD_RES (24)..(24): Bound to PEG
  MOD_RES (29)..(29): AMIDATION
HSQGTFTSDYSKYLDEQAAKEFICWLMNT

SEQ ID NO: 620 - protein, 29 aa, Artificial Sequence
  glucagon analog
  MOD_RES (24)..(24): Bound to PEG
  MOD_RES (29)..(29): AMIDATION
HSQGTFTSDYSKYLDEQAAKEFICWLVKG

SEQ ID NO: 621 - protein, 29 aa, Artificial Sequence
  glucagon analog
  MISC_FEATURE (12)..(16): Lactam ring between side chains at positions 12 and 16
  MOD_RES (24)..(24): Bound to PEG
  MOD_RES (29)..(29): AMIDATION
HSQGTFTSDYSKYLDEQAAKEFICWLVKG

SEQ ID NO: 622 - protein, 29 aa, Artificial Sequence
  glucagon analog
  MISC_FEATURE (16)..(20): Lactam ring between side chains at positions 16 and 20
  MOD_RES (24)..(24): Bound to PEG
  MOD_RES (29)..(29): AMIDATION
HSQGTFTSDYSKYLDEQAAKEFICWLVKG

SEQ ID NO: 623 - protein, 29 aa, Artificial Sequence
  glucagon analog
  MOD_RES (1)..(1): (Des-amino)His
  MOD_RES (24)..(24): Cys-PEG
  MISC_FEATURE (29)..(29): c-term amidation
XSQGTFTSDYSKYLDERRAQDFVCWLMNT

SEQ ID NO: 624 - protein, 29 aa, Artificial Sequence
  glucagon analog
  MOD_RES (1)..(1): (Des-amino)His
  MOD_RES (24)..(24): Cys-PEG
  MISC_FEATURE (29)..(29): c-term amidation
XSQGTFTSDYSKYLDERRAKDFVCWLMNT

SEQ ID NO: 625 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSQGTFTSDYSKYLDERRAKDFVCWLMNT

SEQ ID NO: 626 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSQGTFTSDYSKYLDERRAQDFVCWLMNT

SEQ ID NO: 627 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSQGTFTSDYSKYLDERRAKDFVCWLMNT

SEQ ID NO: 628 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSQGTFTSDYSKYLDKRRAEDFVCWLMNT

SEQ ID NO: 629 - protein, 29 aa, Artificial Sequence
  glucagon analog
  MOD_RES (1)..(1): (Des-amino)His
  MOD_RES (24)..(24): Cys-PEG
  MISC_FEATURE (29)..(29): c-term amidation
XSQGTFTSDYSKYLDERAAKDFVCWLMNT

SEQ ID NO: 630 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSQGTFTSDYSKYLDERAAKDFVCWLMNT

SEQ ID NO: 631 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSQGTFTSDYSKYLDERAAQDFVCWLMNT

SEQ ID NO: 632 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSQGTFTSDYSKYLDERAAKDFVCWLMNT

SEQ ID NO: 633 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSQGTFTSDYSKYLDKRAAEDFVCWLMNT

SEQ ID NO: 634 - protein, 29 aa, Artificial Sequence
  glucagon analog
  MOD_RES (1)..(1): (Des-amino)His
  MOD_RES (24)..(24): Cys-PEG
  MISC_FEATURE (29)..(29): c-term amidation
XSQGTFTSDYSKYLDEQAAKEFICWLMNT

SEQ ID NO: 635 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSQGTFTSDYSKYLDEQAAKEFICWLMNT

SEQ ID NO: 636 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSQGTFTSDYSKYLDEQAAKEFICWLMNT

SEQ ID NO: 637 - protein, 29 aa, Artificial Sequence
  glucagon analog
  MOD_RES (1)..(1): (Des-amino)His
  MOD_RES (24)..(24): Cys-PEG
  MISC_FEATURE (29)..(29): c-term amidation
XSQGTFTSDYSKYLDEQAAKEFICWLVKG

SEQ ID NO: 638 - protein, 29 aa, Artificial Sequence
  glucagon analog
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSQGTFTSDYSKYLDEQAAKEFICWLVKG

SEQ ID NO: 639 - protein, 29 aa, Artificial Sequence
  glucagon analog
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSQGTFTSDYSKYLDEQAAKEFICWLVKG

SEQ ID NO: 640 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDERRAQDFVCWLMNT

SEQ ID NO: 641 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDERRAKDFVCWLMNT

SEQ ID NO: 642 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERRAKDFVCWLMNT

SEQ ID NO: 643 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERRAQDFVCWLMNT

SEQ ID NO: 644 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERRAKDFVCWLMNT

SEQ ID NO: 645 - protein, 29 aa, Artificial Sequence
  Synthetic peptide
  MOD_RES (2)..(2): Aminoisobutyric acid
  MISC_FEATURE (16)..(20): Lactam ring side chains at positions 16 and 20
  MOD_RES (24)..(24): Cys-PEG
  MISC_FEATURE (29)..(29): c-term amidation
HXQGTFTSDYSKYLDKRRAEDFVCWLMNT

SEQ ID NO: 646 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDERAAKDFVCWLMNT

SEQ ID NO: 647 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERAAKDFVCWLMNT

SEQ ID NO: 648 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERAAQDFVCWLMNT

SEQ ID NO: 649 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERAAKDFVCWLMNT

SEQ ID NO: 650 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDKRAAEDFVCWLMNT

SEQ ID NO: 651 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDEQAAKEFICWLMNT

SEQ ID NO: 652 - protein, 29 aa, Artificial Sequence
  Synthetic peptide
  misc_feature (2)..(2): Xaa can be any naturally occurring amino acid
HXQGTFTSDYSKYLDEQAAKEFICWLMNT

SEQ ID NO: 653 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDEQAAKEFICWLMNT

SEQ ID NO: 654 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDEQAAKEFICWLVKG

SEQ ID NO: 655 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDEQAAKEFICWLVKG

SEQ ID NO: 656 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDEQAAKEFICWLVKG

SEQ ID NO: 657 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXQGTFTSDYSKYLDERRAQDFVCWLMNT

SEQ ID NO: 658 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXQGTFTSDYSKYLDERRAKDFVCWLMNT

SEQ ID NO: 659 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERRAKDFVCWLMNT

SEQ ID NO: 660 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERRAQDFVCWLMNT

SEQ ID NO: 661 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERRAKDFVCWLMNT

SEQ ID NO: 662 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDKRRAEDFVCWLMNT

SEQ ID NO: 663 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXQGTFTSDYSKYLDERAAKDFVCWLMNT

SEQ ID NO: 664 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERAAKDFVCWLMNT

SEQ ID NO: 665 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERAAQDFVCWLMNT

SEQ ID NO: 666 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDERAAKDFVCWLMNT

SEQ ID NO: 667 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDKRAAEDFVCWLMNT

SEQ ID NO: 668 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXQGTFTSDYSKYLDEQAAKEFICWLMNT

SEQ ID NO: 669 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDEQAAKEFICWLMNT

SEQ ID NO: 670 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDEQAAKEFICWLMNT

SEQ ID NO: 671 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXQGTFTSDYSKYLDEQAAKEFICWLVKG

SEQ ID NO: 672 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXQGTFTSDYSKYLDEQAAKEFICWLVKG

SEQ ID NO: 673 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDEQAAKEFICWLVKG

SEQ ID NO: 674 - protein, 29 aa, Artificial Sequence
  Synthetic peptide
  MOD_RES (24)..(24): Cys-PEG
  MISC_FEATURE (29)..(29): c-term amidation
HSEGTFTSDYSKYLDERRAQDFVCWLMNT

SEQ ID NO: 675 - protein, 29 aa, Artificial Sequence
  Synthetic peptide
  MOD_RES (24)..(24): Cys-PEG
  MISC_FEATURE (29)..(29): c-term amidation
HSEGTFTSDYSKYLDERRAKDFVCWLMNT

SEQ ID NO: 676 - protein, 29 aa, Artificial Sequence
  Synthetic peptide
  MISC_FEATURE (16)..(20): Lactam ring between side chains at positions 16 and 20
  MOD_RES (24)..(24): Cys-PEG
  MISC_FEATURE (29)..(29): c-term amidation
HSEGTFTSDYSKYLDERRAKDFVCWLMNT

SEQ ID NO: 677 - protein, 29 aa, Artificial Sequence
  Synthetic peptide
  MISC_FEATURE (12)..(16): Lactam ring between side chains at positions 12 and 16
  MOD_RES (24)..(24): Cys-PEG
  MISC_FEATURE (29)..(29): c-term amidation
HSEGTFTSDYSKYLDERRAQDFVCWLMNT

SEQ ID NO: 678 - protein, 29 aa, Artificial Sequence
  Synthetic peptide
  MISC_FEATURE (12)..(16): Lactam ring between side chains at positions 12 and 16
  MOD_RES (24)..(24): Cys-PEG
  MISC_FEATURE (29)..(29): c-term amidation
HSEGTFTSDYSKYLDERRAKDFVCWLMNT

SEQ ID NO: 679 - protein, 29 aa, Artificial Sequence
  Synthetic peptide
  MISC_FEATURE (16)..(20): Lactam ring between side chains at positions 16 and 20
  MOD_RES (24)..(24): Cys-PEG
  MISC_FEATURE (29)..(29): c-term amidation
HSEGTFTSDYSKYLDKRRAEDFVCWLMNT

SEQ ID NO: 680 - protein, 29 aa, Artificial Sequence
  Synthetic peptide
  MOD_RES (24)..(24): Cys-PEG
  MISC_FEATURE (29)..(29): c-term amidation
HSEGTFTSDYSKYLDERAAKDFVCWLMNT

SEQ ID NO: 681 - protein, 29 aa, Artificial Sequence
  Synthetic peptide
  MISC_FEATURE (16)..(20): Lactam ring between side chains at positions 16 and 20
  MOD_RES (24)..(24): Cys-PEG
  MISC_FEATURE (29)..(29): c-term amidation
HSEGTFTSDYSKYLDERAAKDFVCWLMNT

SEQ ID NO: 682 - protein, 29 aa, Artificial Sequence
  Synthetic peptide
  MISC_FEATURE (12)..(16): Lactam ring between side chains at positions 12 and 16
  MOD_RES (24)..(24): Cys-PEG
  MISC_FEATURE (29)..(29): c-term amidation
HSEGTFTSDYSKYLDERAAQDFVCWLMNT

SEQ ID NO: 683 - protein, 29 aa, Artificial Sequence
  Synthetic peptide
  MISC_FEATURE (12)..(16): Lactam ring between side chains at positions 12 and 16
  MOD_RES (24)..(24): Cys-PEG
  MISC_FEATURE (29)..(29): c-term amidation
HSEGTFTSDYSKYLDERAAKDFVCWLMNT

SEQ ID NO: 684 - protein, 29 aa, Artificial Sequence
  Synthetic peptide
  MISC_FEATURE (16)..(20): Lactam ring between side chains at positions 16 and 20
  MOD_RES (24)..(24): Cys-PEG
  MISC_FEATURE (29)..(29): c-term amidation
HSEGTFTSDYSKYLDKRAAEDFVCWLMNT

SEQ ID NO: 685 - protein, 29 aa, Artificial Sequence
  Synthetic peptide
  MOD_RES (24)..(24): Cys-PEG
  MISC_FEATURE (29)..(29): c-term amidation
HSEGTFTSDYSKYLDEQAAKEFICWLMNT

SEQ ID NO: 686 - protein, 29 aa, Artificial Sequence
  Synthetic peptide
  MISC_FEATURE (12)..(16): Lactam ring between side chains at positions 12 and 16
  MOD_RES (24)..(24): Cys-PEG
  MISC_FEATURE (29)..(29): c-term amidation
HSEGTFTSDYSKYLDEQAAKEFICWLMNT

SEQ ID NO: 687 - protein, 29 aa, Artificial Sequence
  Synthetic peptide
  MISC_FEATURE (16)..(20): Lactam ring between side chain at positions 16 and 20
  MOD_RES (24)..(24): Cys-PEG
  MISC_FEATURE (29)..(29): c-term amidation
HSEGTFTSDYSKYLDEQAAKEFICWLMNT

SEQ ID NO: 688 - protein, 29 aa, Artificial Sequence
  Synthetic peptide
  MOD_RES (24)..(24): Cys-PEG
  MISC_FEATURE (29)..(29): c-term amidation
HSEGTFTSDYSKYLDEQAAKEFICWLVKG

SEQ ID NO: 689 - protein, 29 aa, Artificial Sequence
  Synthetic peptide
  MISC_FEATURE (12)..(16): Lactam ring between side chains at positions 12 and 16
  MOD_RES (24)..(24): Cys-PEG
  MISC_FEATURE (29)..(29): c-term amidation
HSEGTFTSDYSKYLDEQAAKEFICWLVKG

SEQ ID NO: 690 - protein, 29 aa, Artificial Sequence
  Synthetic peptide
  MISC_FEATURE (16)..(20): Lactam ring between side chains at positions 16 and 20
  MOD_RES (24)..(24): Cys-PEG
  MISC_FEATURE (29)..(29): c-term amidation
HSEGTFTSDYSKYLDEQAAKEFICWLVKG

SEQ ID NO: 691 - protein, 29 aa, Artificial Sequence
  Synthetic peptide
  MOD_RES (1)..(1): (Des-amino)His
  MOD_RES (24)..(24): Cys-PEG
  MISC_FEATURE (29)..(29): c-term amidation
XSEGTFTSDYSKYLDERRAQDFVCWLMNT

SEQ ID NO: 692 - protein, 29 aa, Artificial Sequence
  Synthetic peptide
  MOD_RES (1)..(1): (Des-amino)His
  MOD_RES (24)..(24): Cys-PEG
  MISC_FEATURE (29)..(29): c-term amidation
XSEGTFTSDYSKYLDERRAKDFVCWLMNT

SEQ ID NO: 693 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSEGTFTSDYSKYLDERRAKDFVCWLMNT

SEQ ID NO: 694 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSEGTFTSDYSKYLDERRAQDFVCWLMNT

SEQ ID NO: 695 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSEGTFTSDYSKYLDERRAKDFVCWLMNT

SEQ ID NO: 696 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSEGTFTSDYSKYLDKRRAEDFVCWLMNT

SEQ ID NO: 697 - protein, 29 aa, Artificial Sequence
  Synthetic peptide
  MOD_RES (1)..(1): (Des-amino)His
  MOD_RES (24)..(24): Cys-PEG
  MISC_FEATURE (29)..(29): c-term amidation
XSEGTFTSDYSKYLDERAAKDFVCWLMNT

SEQ ID NO: 698 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSEGTFTSDYSKYLDERAAKDFVCWLMNT

SEQ ID NO: 699 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSEGTFTSDYSKYLDERAAQDFVCWLMNT

SEQ ID NO: 700 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSEGTFTSDYSKYLDERAAKDFVCWLMNT

SEQ ID NO: 701 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSEGTFTSDYSKYLDKRAAEDFVCWLMNT

SEQ ID NO: 702 - protein, 29 aa, Artificial Sequence
  Synthetic peptide
  MOD_RES (1)..(1): (Des-amino)His
  MOD_RES (24)..(24): Cys-PEG
  MISC_FEATURE (29)..(29): c-term amidation
XSEGTFTSDYSKYLDEQAAKGFICWLMNT

SEQ ID NO: 703 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSEGTFTSDYSKYLDEQAAKGFICWLMNT

SEQ ID NO: 704 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSEGTFTSDYSKYLDEQAAKGFICWLMNT

SEQ ID NO: 705 - protein, 29 aa, Artificial Sequence
  Synthetic peptide
  MOD_RES (1)..(1): (des-amino)His
  MOD_RES (24)..(24): Cys-PEG
  MISC_FEATURE (29)..(29): c-term amidation
XSEGTFTSDYSKYLDEQAAKGFICWLVKG

SEQ ID NO: 706 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MOD_RES (24)..(24): Cys-PEG
  MISC_FEATURE (29)..(29): c-term amidation
XSEGTFTSDYSKYLDEQAAKGFICWLVKG

SEQ ID NO: 707 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MOD_RES (24)..(24): Cys-PEG
  MISC_FEATURE (29)..(29): c-term amidation
XSEGTFTSDYSKYLDEQAAKGFICWLVKG

SEQ ID NO: 708 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXEGTFTSDYSKYLDERRAQDFVCWLMNT

SEQ ID NO: 709 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXEGTFTSDYSKYLDERRAKDFVCWLMNT

SEQ ID NO: 710 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDERRAKDFVCWLMNT

SEQ ID NO: 711 - protein, 29 aa, Artificial Sequence
  Synthetic peptide
  MOD_RES (2)..(2): Aminoisobutyric acid
  MISC_FEATURE (12)..(16): Lactam ring between side chain at positions 12 and 16
  MOD_RES (24)..(24): Cys-PEG
  MISC_FEATURE (29)..(29): c-term amidation
HXEGTFTSDYSKYLDERRAQDFVCWLMNT

SEQ ID NO: 712 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDERRAKDFVCWLMNT

SEQ ID NO: 713 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDKRRAEDFVCWLMNT

SEQ ID NO: 714 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXEGTFTSDYSKYLDERAAKDFVCWLMNT

SEQ ID NO: 715 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDERAAKDFVCWLMNT

SEQ ID NO: 716 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDERAAQDFVCWLMNT

SEQ ID NO: 717 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDERAAKDFVCWLMNT

SEQ ID NO: 718 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDKRAAEDFVCWLMNT

SEQ ID NO: 719 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXEGTFTSDYSKYLDEQAAKEFICWLMNT

SEQ ID NO: 720 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDEQAAKEFICWLMNT

SEQ ID NO: 721 - protein, 29 aa, Artificial Sequence
  Synthetic peptide
  MOD_RES (2)..(2): Aminoisobutyric acid
  MISC_FEATURE (16)..(20): Lactam ring between side chains at position 16 and 20
  MOD_RES (24)..(24): Cys-PEG
  MISC_FEATURE (29)..(29): c-term amidation
HXEGTFTSDYSKYLDEQAAKEFICWLMNT

SEQ ID NO: 722 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXEGTFTSDYSKYLDEQAAKEFICWLVKG

SEQ ID NO: 723 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDEQAAKEFICWLVKG

SEQ ID NO: 724 - protein, 29 aa, Artificial Sequence
  Synthetic peptide
  MOD_RES (2)..(2): Aminoisobutyric acid
  MISC_FEATURE (16)..(20): Lactam ring between side chains at position 16 and 20
  MOD_RES (24)..(24): Cys-PEG
  MISC_FEATURE (29)..(29): c-term amidation
HXEGTFTSDYSKYLDEQAAKEFICWLVKG

SEQ ID NO: 725 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXEGTFTSDYSKYLDERRAQDFVCWLMNT

SEQ ID NO: 726 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXEGTFTSDYSKYLDERRAKDFVCWLMNT

SEQ ID NO: 727 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDERRAKDFVCWLMNT

SEQ ID NO: 728 - protein, 29 aa, Artificial Sequence
  Synthetic peptide
  MOD_RES (2)..(2): D-Ala
  MISC_FEATURE (12)..(16): Lactam between side chains at positions 12 and 16
  MOD_RES (24)..(24): Cys-PEG
  MISC_FEATURE (29)..(29): c-term amidation
HXEGTFTSDYSKYLDERRAQDFVCWLMNT

SEQ ID NO: 729 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDERRAKDFVCWLMNT

SEQ ID NO: 730 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDKRRAEDFVCWLMNT

SEQ ID NO: 731 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXEGTFTSDYSKYLDERAAKDFVCWLMNT

SEQ ID NO: 732 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDERAAKDFVCWLMNT

SEQ ID NO: 733 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDERAAQDFVCWLMNT

SEQ ID NO: 734 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDERAAKDFVCWLMNT

SEQ ID NO: 735 - protein, 29 aa, Artificial Sequence
  Synthetic peptide
  MOD_RES (2)..(2): D-Ala
  MISC_FEATURE (12)..(16): Lactam ring between side chains at positions 16 and 20
  MOD_RES (24)..(24): Cys-PEG
  MISC_FEATURE (29)..(29): c-term amidation
HXEGTFTSDYSKYLDKRAAEDFVCWLMNT

SEQ ID NO: 736 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXEGTFTSDYSKYLDEQAAKEFICWLMNT

SEQ ID NO: 737 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDEQAAKEFICWLMNT

SEQ ID NO: 738 - protein, 29 aa, Artificial Sequence
  Synthetic peptide
  MOD_RES (2)..(2): D-Ala
  MISC_FEATURE (16)..(20): Lactam right between side chains at positions 16 and 20
  MOD_RES (24)..(24): Cys-PEG
  MISC_FEATURE (29)..(29): c-term amidation
HXEGTFTSDYSKYLDEQAAKEFICWLMNT

SEQ ID NO: 739 - protein, 29 aa, Artificial Sequence
  Synthetic peptide
  MOD_RES (2)..(2): D-Ala
  MOD_RES (24)..(24): Cys-PEG
  MISC_FEATURE (29)..(29): c-term amidation
HXEGTFTSDYSKYLDEQAAKEFICWLVKG

SEQ ID NO: 740 - protein, 29 aa, Artificial Sequence
  Synthetic peptide
  MOD_RES (2)..(2): D-Ala
  MISC_FEATURE (12)..(16): Lactam ring between side chains at positions 12 and 16
  MOD_RES (24)..(24): Cys-PEG
  MISC_FEATURE (29)..(29): c-term amidation
HXEGTFTSDYSKYLDEQAAKEFICWLVKG

SEQ ID NO: 741 - protein, 29 aa, Artificial Sequence
  Synthetic peptide
  MOD_RES (2)..(2): D-Ala
  MISC_FEATURE (16)..(20): Lactam ring between side chains at positions 16 and 20
  MOD_RES (24)..(24): Cys-PEG
  MISC_FEATURE (29)..(29): c-term amidation
HXEGTFTSDYSKYLDEQAAKEFICWLVKG

SEQ ID NO: 742 - protein, 29 aa, Artificial Sequence
  Synthetic peptide
  MOD_RES (16)..(16): Cys-PEG
  MISC_FEATURE (29)..(29): c-term amidation
HSQGTFTSDYSKYLDCRRAKDFVQWLMNT

SEQ ID NO: 743 - protein, 29 aa, Artificial Sequence
  Synthetic peptide
  MOD_RES (16)..(16): Cys-PEG
  MISC_FEATURE (29)..(29): c-term amidation
HSQGTFTSDYSKYLDCRAAKDFVQWLMNT

SEQ ID NO: 744 - protein, 29 aa, Artificial Sequence
  Synthetic peptide
  MOD_RES (16)..(16): Cys-PEG
  MISC_FEATURE (29)..(29): c-term amidation
HSQGTFTSDYSKYLDCQAAKEFIAWLMNT

SEQ ID NO: 745 - protein, 29 aa, Artificial Sequence
  Synthetic peptide
  MOD_RES (16)..(16): Cys-PEG
  MISC_FEATURE (29)..(29): c-term amidation
HSQGTFTSDYSKYLDCQAAKEFIAWLVKG

SEQ ID NO: 746 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSQGTFTSDYSKYLDCRRAKDFVQWLMNT

SEQ ID NO: 747 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSQGTFTSDYSKYLDCRAAKDFVQWLMNT

SEQ ID NO: 748 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSQGTFTSDYSKYLDCQAAKEFIAWLMNT

SEQ ID NO: 749 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSQGTFTSDYSKYLDCQAAKEFIAWLVKG

SEQ ID NO: 750 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSQGTFTSDYSKYLDCQAAKEFIAWLMNT

SEQ ID NO: 751 - protein, 29 aa, Artificial Sequence
  Synthetic peptide
  MOD_RES (2)..(2): Aminoisobutyric acid
  MOD_RES (16)..(16): Cys-PEG
  MISC_FEATURE (29)..(29): c-term amidation
HXQGTFTSDYSKYLDCRAAKDFVQWLMNT

SEQ ID NO: 752 - protein, 29 aa, Artificial Sequence
  Synthetic peptide
  MOD_RES (2)..(2): Aminoisobutyric acid
  MOD_RES (16)..(16): Cys-PEG
  MISC_FEATURE (29)..(29): c-term amidation
HXQGTFTSDYSKYLDCQAAKEFIAWLMNT

SEQ ID NO: 753 - protein, 29 aa, Artificial Sequence
  Synthetic peptide
  MOD_RES (2)..(2): Aminoisobutyric acid
  MOD_RES (16)..(16): Cys-PEG
  MISC_FEATURE (29)..(29): c-term amidation
HXQGTFTSDYSKYLDCQAAKEFIAWLVKG

SEQ ID NO: 754 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXQGTFTSDYSKYLDCRRAKDFVQWLMNT

SEQ ID NO: 755 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXQGTFTSDYSKYLDCRAAKDFVQWLMNT

SEQ ID NO: 756 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXQGTFTSDYSKYLDCQAAKEFIAWLMNT

SEQ ID NO: 757 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXQGTFTSDYSKYLDCQAAKEFIAWLVKG

SEQ ID NO: 758 - protein, 29 aa, Artificial Sequence
  Synthetic peptide
  MOD_RES (16)..(16): Cys-PEG
  MISC_FEATURE (29)..(29): c-term amidation
HSEGTFTSDYSKYLDCRRAKDFVQWLMNT

SEQ ID NO: 759 - protein, 29 aa, Artificial Sequence
  Synthetic peptide
  MOD_RES (16)..(16): Cys-PEG
  MISC_FEATURE (29)..(29): c-term amidation
HSEGTFTSDYSKYLDCRAAKDFVQWLMNT

SEQ ID NO: 760 - protein, 29 aa, Artificial Sequence
  Synthetic peptide
  MOD_RES (16)..(16): Cys-PEG
  MISC_FEATURE (29)..(29): c-term amidation
HSEGTFTSDYSKYLDCQAAKEFIAWLMNT

SEQ ID NO: 761 - protein, 29 aa, Artificial Sequence
  Synthetic peptide
  MOD_RES (16)..(16): Cys-PEG
  MISC_FEATURE (29)..(29): c-term amidation
HSEGTFTSDYSKYLDCQAAKEFIAWLVKG

SEQ ID NO: 762 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSEGTFTSDYSKYLDCRRAKDFVQWLMNT

SEQ ID NO: 763 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSEGTFTSDYSKYLDCRAAKDFVQWLMNT

SEQ ID NO: 764 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSEGTFTSDYSKYLDCQAAKEFIAWLMNT

SEQ ID NO: 765 - protein, 29 aa, Artificial Sequence
  Synthetic peptide
  MOD_RES (1)..(1): (Des-amino)His
  MOD_RES (16)..(16): Cys-PEG
  MISC_FEATURE (29)..(29): c-term amidation
XSEGTFTSDYSKYLDCQAAKEFIAWLVKG

SEQ ID NO: 766 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCRRAKDFVQWLMNT

SEQ ID NO: 767 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCRAAKDFVQWLMNT

SEQ ID NO: 768 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCQAAKEFIAWLMNT

SEQ ID NO: 769 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCQAAKEFIAWLVKG

SEQ ID NO: 770 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCRRAKDFVQWLMNT

SEQ ID NO: 771 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCRAAKDFVQWLMNT

SEQ ID NO: 772 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCQAAKEFIAWLMNT

SEQ ID NO: 773 - protein, 29 aa, Artificial Sequence
  Synthetic peptide
  MOD_RES (2)..(2): D-Ala
  MOD_RES (16)..(16): Cys-PEG
  MISC_FEATURE (29)..(29): c-term amidation
HXEGTFTSDYSKYLDCQAAKEFIAWLVKG

SEQ ID NO: 774 - protein, 29 aa, Artificial Sequence
  Synthetic peptide
  MISC_FEATURE (29)..(29): c-term amidation
HSQGTFTSDYSKYLDERRAQDFVQWLMDT

SEQ ID NO: 775 - protein, 29 aa, Artificial Sequence
  Synthetic peptide
  MISC_FEATURE (29)..(29): c-term amidation
HSQGTFTSDYSKYLDERRAKDFVQWLMDT

SEQ ID NO: 776 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSQGTFTSDYSKYLDERRAKDFVQWLMDT

SEQ ID NO: 777 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSQGTFTSDYSKYLDERRAQDFVQWLMDT

SEQ ID NO: 778 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSQGTFTSDYSKYLDERRAKDFVQWLMDT

SEQ ID NO: 779 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSQGTFTSDYSKYLDKRRAEDFVQWLMDT

SEQ ID NO: 780 - protein, 29 aa, Artificial Sequence
  Synthetic peptide
  MISC_FEATURE (29)..(29): c-term amidation
HSQGTFTSDYSKYLDERAAKDFVQWLMDT

SEQ ID NO: 781 - protein, 29 aa, Artificial Sequence
  Synthetic peptide
  MISC_FEATURE (29)..(29): c-term amidation; lactam ring between side chains at positions 16 and 20
HSQGTFTSDYSKYLDERAAKDFVQWLMDT

SEQ ID NO: 782 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSQGTFTSDYSKYLDERAAQDFVQWLMDT

SEQ ID NO: 783 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSQGTFTSDYSKYLDERAAKDFVQWLMDT

SEQ ID NO: 784 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSQGTFTSDYSKYLDKRAAEDFVQWLMDT

SEQ ID NO: 785 - protein, 29 aa, Artificial Sequence
  Synthetic peptide
  MISC_FEATURE (29)..(29): c-term amidation
HSQGTFTSDYSKYLDEQAAKEFIAWLMDT

SEQ ID NO: 786 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSQGTFTSDYSKYLDEQAAKEFIAWLMDT

SEQ ID NO: 787 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSQGTFTSDYSKYLDEQAAKEFIAWLMDT

SEQ ID NO: 788 - protein, 29 aa, Artificial Sequence
  Synthetic peptide
  MOD_RES (1)..(1): (Des-amino)His
  MISC_FEATURE (29)..(29): c-term amidation
XSQGTFTSDYSKYLDERRAQDFVQWLMDT

SEQ ID NO: 789 - protein, 29 aa, Artificial Sequence
  Synthetic peptide
  MOD_RES (1)..(1): (Des-amino)His
  MISC_FEATURE (29)..(29): c-term amidation
XSQGTFTSDYSKYLDERRAKDFVQWLMDT

SEQ ID NO: 790 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSQGTFTSDYSKYLDERRAKDFVQWLMDT

SEQ ID NO: 791 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSQGTFTSDYSKYLDERRAQDFVQWLMDT

SEQ ID NO: 792 - protein, 29 aa, Artificial Sequence
  Synthetic peptide
  misc_feature (1)..(1): Xaa can be any naturally occurring amino acid
XSQGTFTSDYSKYLDERRAKDFVQWLMDT

SEQ ID NO: 793 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSQGTFTSDYSKYLDKRRAEDFVQWLMDT

SEQ ID NO: 794 - protein, 29 aa, Artificial Sequence
  Synthetic peptide
  MOD_RES (1)..(1): (Des-amino)His
  MISC_FEATURE (29)..(29): c-term amidation
XSQGTFTSDYSKYLDERAAKDFVQWLMDT

SEQ ID NO: 795 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSQGTFTSDYSKYLDERAAKDFVQWLMDT

SEQ ID NO: 796 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSQGTFTSDYSKYLDERAAQDFVQWLMDT

SEQ ID NO: 797 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSQGTFTSDYSKYLDERAAKDFVQWLMDT

SEQ ID NO: 798 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSQGTFTSDYSKYLDKRAAEDFVQWLMDT

SEQ ID NO: 799 - protein, 29 aa, Artificial Sequence
  Synthetic peptide
  MOD_RES (1)..(1): (Des-amino)His
  MISC_FEATURE (29)..(29): c-term amidation
XSQGTFTSDYSKYLDEQAAKEFIAWLMDT

SEQ ID NO: 800 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSQGTFTSDYSKYLDEQAAKEFIAWLMDT

SEQ ID NO: 801 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSQGTFTSDYSKYLDEQAAKEFIAWLMDT

SEQ ID NO: 802 - protein, 29 aa, Artificial Sequence
  Synthetic peptide
  MOD_RES (2)..(2): Aminoisobutyric acid
  MISC_FEATURE (29)..(29): c-term amidation
HXQGTFTSDYSKYLDERRAQDFVQWLMDT

SEQ ID NO: 803 - protein, 29 aa, Artificial Sequence
  Synthetic peptide
  MOD_RES (2)..(2): Aminoisobutyric acid
  MISC_FEATURE (29)..(29): c-term amidation
HXQGTFTSDYSKYLDERRAKDFVQWLMDT

SEQ ID NO: 804 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXQGTFTSDYSKYLDERRAKDFVQWLMDT

SEQ ID NO: 805 - protein, 29 aa, Artificial Sequence
  Synthetic peptide
  MOD_RES (2)..(2): aminoisobutyric acid
  MISC_FEATURE (12)..(16): Lactam ring between side chains at positions 12 and 16
  MISC_FEATURE (29)..(29): c-term amidation
HXQGTFTSDYSKYLDERRAQDFVQWLMDT

SEQ ID NO: 806 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXQGTFTSDYSKYLDERRAKDFVQWLMDT

SEQ ID NO: 807 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXQGTFTSDYSKYLDKRRAEDFVQWLMDT

SEQ ID NO: 808 - protein, 29 aa, Artificial Sequence
  Synthetic peptide
  MOD_RES (2)..(2): Aminoisobutyric acid
  MISC_FEATURE (29)..(29): c-term amidation
HXQGTFTSDYSKYLDERAAKDFVQWLMDT

SEQ ID NO: 809 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXQGTFTSDYSKYLDERAAKDFVQWLMDT

SEQ ID NO: 810 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXQGTFTSDYSKYLDERAAQDFVQWLMDT

SEQ ID NO: 811 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXQGTFTSDYSKYLDERAAKDFVQWLMDT

SEQ ID NO: 812 - protein, 29 aa, Artificial Sequence
  Synthetic peptide
  MOD_RES (2)..(2): Aminoisobutyric acid
  MISC_FEATURE (12)..(16): Lactam ring between side chains at positions 16 and 20
  MISC_FEATURE (29)..(29): c-term amidation
HXQGTFTSDYSKYLDKRAAEDFVQWLMDT

SEQ ID NO: 813 - protein, 29 aa, Artificial Sequence
  Synthetic peptide
  MOD_RES (2)..(2): Aminoisobutyric acid
  MISC_FEATURE (29)..(29): c-term amidation
HXQGTFTSDYSKYLDEQAAKEFIAWLMDT

SEQ ID NO: 814 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXQGTFTSDYSKYLDEQAAKEFIAWLMDT

SEQ ID NO: 815 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXQGTFTSDYSKYLDEQAAKEFIAWLMDT

SEQ ID NO: 816 - protein, 29 aa, Artificial Sequence
  Synthetic peptide
  MOD_RES (2)..(2): D-Ala
  MISC_FEATURE (29)..(29): c-term amidation
HXQGTFTSDYSKYLDERRAQDFVQWLMDT

SEQ ID NO: 817 - protein, 29 aa, Artificial Sequence
  Synthetic peptide
  MOD_RES (2)..(2): D-Ala
  MISC_FEATURE (29)..(29): c-term amidation
HXQGTFTSDYSKYLDERRAKDFVQWLMDT

SEQ ID NO: 818 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXQGTFTSDYSKYLDERRAKDFVQWLMDT

SEQ ID NO: 819 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXQGTFTSDYSKYLDERRAQDFVQWLMDT

SEQ ID NO: 820 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXQGTFTSDYSKYLDERRAKDFVQWLMDT

SEQ ID NO: 821 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXQGTFTSDYSKYLDKRRAEDFVQWLMDT

SEQ ID NO: 822 - protein, 29 aa, Artificial Sequence
  Synthetic peptide
  MOD_RES (2)..(2): D-Ala
  MISC_FEATURE (29)..(29): c-term amidation
HXQGTFTSDYSKYLDERAAKDFVQWLMDT

SEQ ID NO: 823 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXQGTFTSDYSKYLDERAAKDFVQWLMDT

SEQ ID NO: 824 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXQGTFTSDYSKYLDERAAQDFVQWLMDT

SEQ ID NO: 825 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXQGTFTSDYSKYLDERAAKDFVQWLMDT

SEQ ID NO: 826 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXQGTFTSDYSKYLDKRAAEDFVQWLMDT

SEQ ID NO: 827 - protein, 29 aa, Artificial Sequence
  Synthetic peptide
  MOD_RES (2)..(2): D-Ala
  MISC_FEATURE (29)..(29): c-term amidation
HXQGTFTSDYSKYLDEQAAKEFIAWLMDT

SEQ ID NO: 828 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXQGTFTSDYSKYLDEQAAKEFIAWLMDT

SEQ ID NO: 829 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXQGTFTSDYSKYLDEQAAKEFIAWLMDT

SEQ ID NO: 830 - protein, 29 aa, Artificial Sequence
  Synthetic peptide
  MISC_FEATURE (29)..(29): c-term amidation
HSEGTFTSDYSKYLDERRAQDFVQWLMDT

SEQ ID NO: 831 - protein, 29 aa, Artificial Sequence
  Synthetic peptide
  MISC_FEATURE (29)..(29): c-term amidation
HSEGTFTSDYSKYLDERRAKDFVQWLMDT

SEQ ID NO: 832 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSEGTFTSDYSKYLDERRAKDFVQWLMDT

SEQ ID NO: 833 - protein, 29 aa, Artificial Sequence
  Synthetic peptide
  MISC_FEATURE (16)..(16): Lactam ring between side chains at positions 12 and 16
  MISC_FEATURE (29)..(29): c-term amidation
HSEGTFTSDYSKYLDERRAQDFVQWLMDT

SEQ ID NO: 834 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSEGTFTSDYSKYLDERRAKDFVQWLMDT

SEQ ID NO: 835 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSEGTFTSDYSKYLDKRRAEDFVQWLMDT

SEQ ID NO: 836 - protein, 29 aa, Artificial Sequence
  Synthetic peptide
  MISC_FEATURE (29)..(29): c-term amidation
HSEGTFTSDYSKYLDERAAKDFVQWLMDT

SEQ ID NO: 837 - protein, 29 aa, Artificial Sequence
  Synthetic peptide
  MISC_FEATURE (1)..(40): Lactam ring between side chains at positions 16 and 20
  MISC_FEATURE (29)..(29): c-term amidation
HSEGTFTSDYSKYLDERAAKDFVQWLMDT

SEQ ID NO: 838 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSEGTFTSDYSKYLDERAAQDFVQWLMDT

SEQ ID NO: 839 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSEGTFTSDYSKYLDERAAKDFVQWLMDT

SEQ ID NO: 840 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSEGTFTSDYSKYLDKRAAEDFVQWLMDT

SEQ ID NO: 841 - protein, 29 aa, Artificial Sequence
  Synthetic peptide
  MISC_FEATURE (29)..(29): c-term amidation
HSEGTFTSDYSKYLDEQAAKEFIAWLMDT

SEQ ID NO: 842 - protein, 29 aa, Artificial Sequence
  Synthetic peptide
  MISC_FEATURE (12)..(16): Lactam ring between side chains at positions 12 and 16
  MISC_FEATURE (29)..(29): c-term amidation
HSEGTFTSDYSKYLDEQAAKEFIAWLMDT

SEQ ID NO: 843 - protein, 29 aa, Artificial Sequence
  Synthetic peptide
  MISC_FEATURE (16)..(20): Lactam ring between side chains at positions 16 and 20
  MISC_FEATURE (29)..(29): c-term amidation
HSEGTFTSDYSKYLDEQAAKEFIAWLMDT

SEQ ID NO: 844 - protein, 29 aa, Artificial Sequence
  Synthetic peptide
  MOD_RES (1)..(1): (Des-amino)His
  MISC_FEATURE (29)..(29): c-term amidation
XSEGTFTSDYSKYLDERRAQDFVQWLMDT

SEQ ID NO: 845 - protein, 29 aa, Artificial Sequence
  Synthetic peptide
  MOD_RES (1)..(1): (Des-amino)His
  MISC_FEATURE (29)..(29): c-term amidation
XSEGTFTSDYSKYLDERRAKDFVQWLMDT

SEQ ID NO: 846 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSEGTFTSDYSKYLDERRAKDFVQWLMDT

SEQ ID NO: 847 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSEGTFTSDYSKYLDERRAQDFVQWLMDT

SEQ ID NO: 848 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSEGTFTSDYSKYLDERRAKDFVQWLMDT

SEQ ID NO: 849 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSEGTFTSDYSKYLDKRRAEDFVQWLMDT

SEQ ID NO: 850 - protein, 29 aa, Artificial Sequence
  Synthetic peptide
  MOD_RES (1)..(1): (Des-amino)His
  MISC_FEATURE (29)..(29): c-term amidation
XSEGTFTSDYSKYLDERAAKDFVQWLMDT

SEQ ID NO: 851 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSEGTFTSDYSKYLDERAAKDFVQWLMDT

SEQ ID NO: 852 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSEGTFTSDYSKYLDERAAQDFVQWLMDT

SEQ ID NO: 853 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSEGTFTSDYSKYLDERAAKDFVQWLMDT

SEQ ID NO: 854 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSEGTFTSDYSKYLDKRAAEDFVQWLMDT

SEQ ID NO: 855 - protein, 29 aa, Artificial Sequence
  Synthetic peptide
  MOD_RES (1)..(1): (Des-amino)His
  MISC_FEATURE (29)..(29): c-term amidation
XSEGTFTSDYSKYLDEQAAKEFIAWLMDT

SEQ ID NO: 856 - protein, 29 aa, Artificial Sequence
  Synthetic peptide
  MOD_RES (1)..(1): (Des-amino)His
  MISC_FEATURE (12)..(16): Lactam ring between side chains at positions 12 and 16
  MISC_FEATURE (29)..(29): c-term amidation
XSEGTFTSDYSKYLDEQAAKEFIAWLMDT

SEQ ID NO: 857 - protein, 29 aa, Artificial Sequence
  Synthetic peptide
  MOD_RES (1)..(1): (Des-amino)His
  MISC_FEATURE (16)..(20): Lactam ring between side chains at positions 16 and 20
  MISC_FEATURE (29)..(29): c-term amidation
XSEGTFTSDYSKYLDEQAAKEFIAWLMDT

SEQ ID NO: 858 - protein, 29 aa, Artificial Sequence
  Synthetic peptide
  MOD_RES (2)..(2): Aminoisobutyric acid
  MISC_FEATURE (29)..(29): c-term amidation
HXEGTFTSDYSKYLDERRAQDFVQWLMDT

SEQ ID NO: 859 - protein, 29 aa, Artificial Sequence
  Synthetic peptide
  MOD_RES (2)..(2): Aminoisobutyric acid
  MISC_FEATURE (29)..(29): c-term amidation
HXEGTFTSDYSKYLDERRAKDFVQWLMDT

SEQ ID NO: 860 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXEGTFTSDYSKYLDERRAKDFVQWLMDT

SEQ ID NO: 861 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXEGTFTSDYSKYLDERRAQDFVQWLMDT

SEQ ID NO: 862 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXEGTFTSDYSKYLDERRAKDFVQWLMDT

SEQ ID NO: 863 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXEGTFTSDYSKYLDKRRAEDFVQWLMDT

SEQ ID NO: 864 - protein, 29 aa, Artificial Sequence
  Synthetic peptide
  MOD_RES (2)..(2): Aminoisobutyric acid
  MISC_FEATURE (29)..(29): c-term amidation
HXEGTFTSDYSKYLDERAAKDFVQWLMDT

SEQ ID NO: 865 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXEGTFTSDYSKYLDERAAKDFVQWLMDT

SEQ ID NO: 866 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXEGTFTSDYSKYLDERAAQDFVQWLMDT

SEQ ID NO: 867 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXEGTFTSDYSKYLDERAAKDFVQWLMDT

SEQ ID NO: 868 - protein, 29 aa, Artificial Sequence
  Synthetic peptide
  MOD_RES (2)..(2): Aminoisobutyric acid
  MISC_FEATURE (12)..(16): Lactam ring between side chains at positions 16 and 20
  MISC_FEATURE (29)..(29): c-term amidation
HXEGTFTSDYSKYLDKRAAEDFVQWLMDT

SEQ ID NO: 869 - protein, 29 aa, Artificial Sequence
  Synthetic peptide
  MOD_RES (2)..(2): Aminoisobutyric acid
  MISC_FEATURE (29)..(29): c-term amidation
HXEGTFTSDYSKYLDEQAAKEFIAWLMDT

SEQ ID NO: 870 - protein, 29 aa, Artificial Sequence
  Synthetic peptide
  MOD_RES (2)..(2): Aminoisobutyric acid
  MISC_FEATURE (12)..(16): Lactam ring between side chains at positions 12 and 16
  MISC_FEATURE (29)..(29): c-term amidation
HXEGTFTSDYSKYLDEQAAKEFIAWLMDT

SEQ ID NO: 871 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MISC_FEATURE (29)..(29): c-term amidation
HXEGTFTSDYSKYLDEQAAKEFIAWLMDT

SEQ ID NO: 872 - protein, 29 aa, Artificial Sequence
  Synthetic peptide
  MOD_RES (2)..(2): D-Ala
  MISC_FEATURE (29)..(29): c-term amidation
HXEGTFTSDYSKYLDERRAQDFVQWLMDT

SEQ ID NO: 873 - protein, 29 aa, Artificial Sequence
  Synthetic peptide
  MOD_RES (2)..(2): D-Ala
  MISC_FEATURE (29)..(29): c-term amidation
HXEGTFTSDYSKYLDERRAKDFVQWLMDT

SEQ ID NO: 874 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXEGTFTSDYSKYLDERRAKDFVQWLMDT

SEQ ID NO: 875 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXEGTFTSDYSKYLDERRAQDFVQWLMDT

SEQ ID NO: 876 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXEGTFTSDYSKYLDERRAKDFVQWLMDT

SEQ ID NO: 877 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXEGTFTSDYSKYLDKRRAEDFVQWLMDT

SEQ ID NO: 878 - protein, 29 aa, Artificial Sequence
  Synthetic peptide
  MOD_RES (2)..(2): D-Ala
  MISC_FEATURE (29)..(29): c-term amidation
HXEGTFTSDYSKYLDERAAKDFVQWLMDT

SEQ ID NO: 879 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXEGTFTSDYSKYLDERAAKDFVQWLMDT

SEQ ID NO: 880 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXEGTFTSDYSKYLDERAAQDFVQWLMDT

SEQ ID NO: 881 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXEGTFTSDYSKYLDERAAKDFVQWLMDT

SEQ ID NO: 882 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXEGTFTSDYSKYLDKRAAEDFVQWLMDT

SEQ ID NO: 883 - protein, 29 aa, Artificial Sequence
  Synthetic peptide
  MOD_RES (2)..(2): D-Ala
  MISC_FEATURE (29)..(29): c-term amidation
HXEGTFTSDYSKYLDEQAAKEFIAWLMDT

SEQ ID NO: 884 - protein, 29 aa, Artificial Sequence
  Synthetic peptide
  MOD_RES (2)..(2): D-Ala
  MISC_FEATURE (12)..(16): Lactam ring between side chains at positions 12 and 16
  MISC_FEATURE (29)..(29): c-term amidation
HXEGTFTSDYSKYLDEQAAKEFIAWLMDT

SEQ ID NO: 885 - protein, 29 aa, Artificial Sequence
  Synthetic peptide
  MOD_RES (2)..(2): D-Ala
  MISC_FEATURE (16)..(20): Lactam ring between side chains at positions 16 and 20
  MISC_FEATURE (29)..(29): c-term amidation
HXEGTFTSDYSKYLDEQAAKEFIAWLMDT

SEQ ID NO: 886 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDEQAAKEFICWLMNT

SEQ ID NO: 887 - protein, 29 aa, Artificial Sequence
  Synthetic peptide
  MOD_RES (2)..(2): Aminoisobutyric acid
  MISC_FEATURE (29)..(29): c-term amidation
  MOD_RES (29)..(29): Cys-PEG
HXQGTFTSDYSKYLDEQAAKEFIAWLMNC

SEQ ID NO: 888 - protein, 40 aa, Artificial Sequence
  Synthetic peptide
  MOD_RES (2)..(2): Aminoisobutyric acid
  MOD_RES (29)..(29): Cys-PEG
  MISC_FEATURE (40)..(40): c-term amidation
HXQGTFTSDYSKYLDEQAAKEFIAWLMNGGPSSGAPPPSC

SEQ ID NO: 889 - protein, 40 aa, Artificial Sequence; identical to SEQ ID NO: 888
  Synthetic peptide
  MOD_RES (2)..(2): Aminoisobutyric acid
  MISC_FEATURE (16)..(20): Lactam ring between side chains at positions 16 and 20
  MOD_RES (29)..(29): Cys-PEG
  MISC_FEATURE (40)..(40): c-term amidation

SEQ ID NO: 890 - protein, 39 aa, Artificial Sequence
  Synthetic peptide
  MOD_RES (2)..(2): Aminoisobutyric acid
  MOD_RES (24)..(24): Cys-PEG
  MISC_FEATURE (39)..(39): c-term amidation
HXQGTFTSDYSKYLDEQAAKEFICWLMNGGPSSGAPPPS

SEQ ID NO: 891 - protein, 39 aa, Artificial Sequence; identical to SEQ ID NO: 890
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (39)..(39): c-term amidation

SEQ ID NO: 892 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDERAAKDFVCWLMNT

SEQ ID NO: 893 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDERAAKDFVQWLMNC

SEQ ID NO: 894 - protein, 40 aa, Artificial Sequence
  Synthetic peptide
  MOD_RES (2)..(2): Aminoisobutyric acid
  MOD_RES (24)..(24): Cys-PEG
  MISC_FEATURE (40)..(40): c-term amidation
HXQGTFTSDYSKYLDERAAKDFVQWLMNGGPSSGAPPPSC

SEQ ID NO: 895 - protein, 40 aa, Artificial Sequence; identical to SEQ ID NO: 894
  Synthetic peptide
  MOD_RES (2)..(2): Aminoisobutyric acid
  MISC_FEATURE (16)..(20): Lactam ring between side chains at positions 16 and 20
  MOD_RES (29)..(29): Cys-PEG
  MISC_FEATURE (40)..(40): c-term amidation

SEQ ID NO: 896 - protein, 39 aa, Artificial Sequence
  Synthetic peptide
  MOD_RES (2)..(2): Aminoisobutyric acid
  MOD_RES (24)..(24): Cys-PEG
  MISC_FEATURE (39)..(39): c-term amidation
HXQGTFTSDYSKYLDERAAKDFVCWLMNGGPSSGAPPPS

SEQ ID NO: 897 - protein, 39 aa, Artificial Sequence; identical to SEQ ID NO: 896
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (39)..(39): c-term amidation

SEQ ID NO: 898 - protein, 30 aa, Artificial Sequence
  Synthetic peptide
  MOD_RES (2)..(2): Aminoisobutyric acid
  MOD_RES (24)..(24): Cys-PEG
  MISC_FEATURE (30)..(30): c-term amidation
HXQGTFTSDYSKYLDERRAKDFVCWLMNTA

SEQ ID NO: 899 - protein, 29 aa, Artificial Sequence
  Synthetic peptide
  MOD_RES (2)..(2): Aminoisobutyric acid
  MOD_RES (24)..(24): Cys-PEG
  MISC_FEATURE (29)..(29): c-term amidation
HXQGTFTSDYSKYLDERRAKDFVQWLMNC

SEQ ID NO: 900 - protein, 40 aa, Artificial Sequence
  Synthetic peptide
  MOD_RES (2)..(2): Aminoisobutyric acid
  MOD_RES (29)..(29): Cys-PEG
  MISC_FEATURE (40)..(40): c-term amidation
HXQGTFTSDYSKYLDERRAKDFVQWLMNGGPSSGAPPPSC

SEQ ID NO: 901 - protein, 40 aa, Artificial Sequence; identical to SEQ ID NO: 900
  Synthetic peptide
  MOD_RES (2)..(2): Aminoisobutyric acid
  MISC_FEATURE (16)..(20): Lactam ring between side chains at positions 16 and 20
  MOD_RES (29)..(29): Cys-PEG
  MISC_FEATURE (40)..(40): c-term amidation

SEQ ID NO: 902 - protein, 39 aa, Artificial Sequence
  Synthetic peptide
  MOD_RES (2)..(2): Aminoisobutyric acid
  MOD_RES (24)..(24): Cys-PEG
  MISC_FEATURE (39)..(39): c-term amidation
HXQGTFTSDYSKYLDERRAKDFVCWLMNGGPSSGAPPPS

SEQ ID NO: 903 - protein, 39 aa, Artificial Sequence; identical to SEQ ID NO: 902
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (39)..(39): c-term amidation

SEQ ID NO: 904 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDEQAAKEFICWLMNT

SEQ ID NO: 905 - protein, 29 aa, Artificial Sequence
  Synthetic peptide
  MOD_RES (1)..(1): Alpha, Alpha-Dimethyl Imidiazole Acetic Acid
  MISC_FEATURE (16)..(20): Lactam ring between side chains at positions 16 and 20
  MOD_RES (24)..(24): Cys-PEG
  MISC_FEATURE (29)..(29): c-term amidation
XSQGTFTSDYSKYLDEQAAKEFICWLMNT

SEQ ID NO: 906 - protein, 29 aa, Artificial Sequence
  Synthetic peptide
  MOD_RES (1)..(1): Alpha, Alpha-Dimethly Imidiazole Acetic Acid
  MOD_RES (1)..(1): Alpha, Alpha-Dimethly Imidiazole Acetic Acid
  MISC_FEATURE (16)..(20): Lactam ring between side chains at positions 16 and 20
  MISC_FEATURE (29)..(29): c-term amidation
  MOD_RES (29)..(29): Cys-PEG
XSQGTFTSDYSKYLDEQAAKEFIAWLMNC

SEQ ID NO: 907 - protein, 40 aa, Artificial Sequence
  Synthetic peptide
  MOD_RES (1)..(1): Alpha, Alpha Dimethyl Imidiazole Acetic Acid
  MISC_FEATURE (16)..(20): Lactam ring between side chains at positions 16 and 20
  MOD_RES (29)..(29): Cys-PEG
  MISC_FEATURE (40)..(40): c-term amidation
XSQGTFTSDYSKYLDEQAAKEFIAWLMNGGPSSGAPPPSC

SEQ ID NO: 908 - protein, 40 aa, Artificial Sequence
  Synthetic peptide
  MOD_RES (1)..(1): Alpha, Alpha Dimethyl Imidiazole Acetic Acid
  MISC_FEATURE (16)..(20): Lactam ring between side chains at positions 16 and 20
  MOD_RES (29)..(29): Cys-PEG
  MISC_FEATURE (40)..(40): c-term amidation
XSQGTFTSDYSKYLDERRAKDFVQWLMNGGPSSGAPPPSC

SEQ ID NO: 909 - protein, 39 aa, Artificial Sequence
  Synthetic peptide
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
  MISC_FEATURE (39)..(39): c-term amidation
XSQGTFTSDYSKYLDEQAAKEFICWLMNGGPSSGAPPPS

SEQ ID NO: 910 - protein, 29 aa, Artificial Sequence
  Synthetic peptide
  MOD_RES (1)..(1): Alpha, Alpha Dimethyl Imidiazole Acetic Acid
  misc_feature (2)..(2): Xaa can be any naturally occurring amino acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERRAKDFVCWLMNT

SEQ ID NO: 911 - protein, 29 aa, Artificial Sequence
  Synthetic peptide
  MOD_RES (2)..(2): Alpha, Alpha Dimethyl Imidiazole Acetic Acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERRAKDFVCWLMNT

SEQ ID NO: 912 - protein, 29 aa, Artificial Sequence
  Synthetic peptide
  MOD_RES (1)..(1): Alpha, Alpha Dimethyl Imidiazole Acetic Acid
  MISC_FEATURE (16)..(20): Lactam ring between side chains at positions 16 and 20
  MISC_FEATURE (29)..(29): c-term amidation
  MOD_RES (29)..(29): Cys-PEG
XSQGTFTSDYSKYLDERRAKDFVQWLMNC

SEQ ID NO: 913 - protein, 39 aa, Artificial Sequence
  Synthetic peptide
  MOD_RES (1)..(1): Alpha, Alpha Dimethyl Imidiazole Acetic Acid
  MISC_FEATURE (16)..(20): Lactam ring between side chains at positions 16 and 20
  MOD_RES (24)..(24): Cys-PEG
  MISC_FEATURE (39)..(39): c-term amidation
XSQGTFTSDYSKYLDERRAKDFVCWLMNGGPSSGAPPPS

SEQ ID NO: 914 - protein, 29 aa, Artificial Sequence
  Synthetic peptide
  MISC_FEATURE (16)..(20): Lactam ring between side chains at positions 16 and 20
  MOD_RES (24)..(24): Cys-PEG
  MISC_FEATURE (29)..(29): c-term amidation
HSQGTFTSDYSKYLDEQAAKEFICWLMNT

SEQ ID NO: 915 - protein, 11 aa, Artificial Sequence
  Synthetic peptide
GGPSSGAPPPS

SEQ ID NO: 916 - protein, 12 aa, Artificial Sequence
  Synthetic peptide
  MOD_RES (12)..(12): Cys-PEG
GGPSSGAPPPSC

SEQ ID NO: 917 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERRAKDFVCWLMNT

SEQ ID NO: 918 - protein, 29 aa, Artificial Sequence
  Synthetic peptide
  MOD_RES (24)..(24): Cys-PEG
  MISC_FEATURE (29)..(29): c-term amidation
HSQGTFTSDYSKYLDEQAAKEFICWLMNT

SEQ ID NO: 919 - protein, 29 aa, Artificial Sequence
  Synthetic peptide
  MOD_RES (1)..(1): Alpha, Alpha Dimethly Imidiazole Acetic Acid
  MOD_RES (24)..(24): Cys-PEG
  MISC_FEATURE (29)..(29): c-term amidation
XSQGTFTSDYSKYLDEQAAKEFICWLMNT

SEQ ID NO: 920 - protein, 29 aa, Artificial Sequence
  Synthetic peptide
  MOD_RES (1)..(1): Alpha, Alpha Dimethyl Imidiazole Acetic Acid
  MISC_FEATURE (29)..(29): c-term amidation
  MOD_RES (29)..(29): Cys-PEG
XSQGTFTSDYSKYLDEQAAKEFIAWLMNC

SEQ ID NO: 921 - protein, 39 aa, Artificial Sequence; identical to SEQ ID NO: 436
  Synthetic peptide
  MISC_FEATURE (39)..(39): c-term amidation

SEQ ID NO: 922 - protein, 39 aa, Artificial Sequence
  Synthetic peptide
  MISC_FEATURE (39)..(39): c-term amidation
HSQGTFTSDYSKYLDSRRAQDFVQWLMNGGPSSGAPPPS

SEQ ID NO: 923 - protein, 39 aa, Artificial Sequence
  Synthetic peptide
  MISC_FEATURE (39)..(39): c-term amidation
HSQGTFTSDYSKYLDSRRAQDFVQWLMKGGPSSGAPPPS

SEQ ID NO: 924 - protein, 39 aa, Artificial Sequence
  Synthetic peptide
  MISC_FEATURE (39)..(39): c-term amidation
HSQGTFTSDYSKYLDSRRAQDFVQWLVKGGPSSGAPPPS

SEQ ID NO: 925 - protein, 39 aa, Artificial Sequence
  Synthetic peptide
  MISC_FEATURE (39)..(39): c-term amidation
HSQGTFTSDYSKYLDSRRAQDFVQWLMDGGPSSGAPPPS

SEQ ID NO: 926 - protein, 39 aa, Artificial Sequence
  Synthetic peptide
  MISC_FEATURE (39)..(39): c-term amidation
HSQGTFTSDYSKYLDERRAKDFVQWLMDGGPSSGAPPPS

SEQ ID NO: 927 - protein, 30 aa, Artificial Sequence
  Synthetic peptide
  MISC_FEATURE (30)..(30): c-term amidation
HAEGTFTSDVSSYLEGQAAKEFIAWLVKGG

SEQ ID NO: 928 - protein, 29 aa, Artificial Sequence
  Synthetic peptide
  MOD_RES (2)..(2): Aminoisobutyric acid
  MISC_FEATURE (16)..(20): Lactam ring between side chains at positions 16 and 20
  MOD_RES (24)..(24): Cys-PEG
  MISC_FEATURE (29)..(29): c-term amidation
HXQGTFTSDYSKYLDERRAKDFVCWLMNT

SEQ ID NO: 929 - protein, 39 aa, Artificial Sequence; identical to SEQ ID NO: 913
  Synthetic peptide
  MOD_RES (1)..(1): Alpha, Alpha Dimethyl Imidiazole Acetic Acid
  MOD_RES (24)..(24): Cys-PEG
  MISC_FEATURE (39)..(39): c-term amidation

SEQ ID NO: 930 - protein, 29 aa, Artificial Sequence
  Synthetic peptide
  MOD_RES (1)..(1): Alpha, Alpha Dimethyl Imidiazole Acetic Acid
  MOD_RES (24)..(24): Cys-PEG
  MISC_FEATURE (29)..(29): c-term amidation
XSQGTFTSDYSKYLDERRAKDFVCWLMNT

SEQ ID NO: 931 - protein, 40 aa, Artificial Sequence
  Synthetic peptide
  MOD_RES (2)..(2): Aminoisobutyric acid
  MOD_RES (24)..(24): Cys-PEG
  MOD_RES (29)..(29): Cys-PEG
  MISC_FEATURE (40)..(40): c-term amidation
HXQGTFTSDYSKYLDERRAKEFICWLMNGGPSSGAPPPSC

SEQ ID NO: 932 - protein, 41 aa, Artificial Sequence
  Synthetic peptide
  MOD_RES (2)..(2): Aminoisobutyric acid
  MOD_RES (29)..(29): Cys-PEG
  MISC_FEATURE (41)..(41): c-term amidation
  MOD_RES (41)..(41): Cys-PEG
HXQGTFTSDYSKYLDEQAAKEFIAWLMNGGPSSGAPPPSCC

SEQ ID NO: 933 - protein, 39 aa, Artificial Sequence; identical to SEQ ID NO: 890
  Synthetic peptide
  MOD_RES (2)..(2): Aminoisobutyric acid
  MOD_RES (24)..(24): Cys-PEG
  MISC_FEATURE (39)..(39): c-term amidation

SEQ ID NO: 934 - protein, 29 aa, Artificial Sequence
  Synthetic peptide
  MISC_FEATURE (1)..(29): Chimera 2 AIB2 K10-C8 Cys 24-40K
  MOD_RES (2)..(2): Aminoisobutyric acid
  MOD_RES (10)..(10): Acylated with C8 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 935 - protein, 29 aa, Artificial Sequence
  Synthetic peptide
  MISC_FEATURE (1)..(29): Chimera 2 AIB2 K10-C14 Cys 24-40K
  MOD_RES (2)..(2): Aminoisobutyric acid
  MOD_RES (10)..(10): Acylated with C14 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 936 - protein, 29 aa, Artificial Sequence
  Synthetic peptide
  MISC_FEATURE (1)..(29): Chimera 2 AIB2 K10-C16 Cys24-40K
  MOD_RES (2)..(2): Aminoisobutyric acid
  MOD_RES (10)..(10): Acylated with C16 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 937 - protein, 29 aa, Artificial Sequence
  Synthetic peptide
  MISC_FEATURE (1)..(29): Chimera 2 AIB2 K10-C18 Cys24-40K
  MOD_RES (2)..(2): Aminoisobutyric acid
  MOD_RES (10)..(10): Acylated with C18 fatty acid
  MOD_RES (24)..(24): Cys-PEG
  MISC_FEATURE (29)..(29): c-term amidation
HXQGTFTSDKSKYLDEQAAKEFICWLMNT

SEQ ID NO: 938 - protein, 29 aa, Artificial Sequence
  Synthetic peptide
  MISC_FEATURE (1)..(29): Chimera 2 K10-C18 Cys24-40K
  MOD_RES (10)..(10): Acylated with C18 fatty acid
  MOD_RES (24)..(24): Cys-PEG
  MISC_FEATURE (29)..(29): c-term amidation
HSQGTFTSDKSKYLDEQAAKEFICWLMNT

SEQ ID NO: 939 - protein, 29 aa, Artificial Sequence
  Synthetic peptide
  MISC_FEATURE (1)..(29): Glucagon E16 K20 K10-C18 Cys24-40K
  MOD_RES (10)..(10): Acylated with C18 fatty acid
  MOD_RES (24)..(24): Cys-PEG
HSQGTFTSDKSKYLDERRAKDFVCWLMNT

SEQ ID NO: 940 - protein, 29 aa, Artificial Sequence
  Synthetic peptide
  MISC_FEATURE (1)..(29): Glucagon E16 K20 K10-W-C18
  MOD_RES (10)..(10): Covalently bound to Trp residue comprising a C18 fatty acid
  MISC_FEATURE (29)..(29): c-term amidation
HSQGTFTSDKSKYLDERRAKDFVQWLMNT

SEQ ID NO: 941 - protein, 29 aa, Artificial Sequence
  Synthetic peptide
  MISC_FEATURE (1)..(29): Glucagon E16 K20 K10-W-C16 Cys24-40K
  MOD_RES (10)..(10): Covalently bound to Trp residue comprising a C16 fatty acid
  MOD_RES (24)..(24): Cys-PEG
HSQGTFTSDKSKYLDERRAKDFVCWLMNT

SEQ ID NO: 942 - protein, 29 aa, Artificial Sequence
  Synthetic peptide
  MISC_FEATURE (1)..(29): Glucagon E16 K20 K10-C16
  MOD_RES (10)..(10): Covalently bound to C16 fatty acid
  MISC_FEATURE (29)..(29): c-term amidation
HSQGTFTSDKSKYLDERRAKDFVQWLMNT

SEQ ID NO: 943 - protein, 29 aa, Artificial Sequence
  Synthetic peptide
  MISC_FEATURE (1)..(29): Glucagon E16 K20 K10-C16
  MOD_RES (10)..(10): Covalently bound to Trp residue comprising a C16 fatty acid
  MISC_FEATURE (29)..(29): c-term amidation
HSQGTFTSDKSKYLDERRAKDFVQWLMNT

SEQ ID NO: 944 - protein, 29 aa, Artificial Sequence
  Synthetic peptide
  MISC_FEATURE (1)..(29): Glucagon E16 K20 K10-C18
  MOD_RES (10)..(10): Covalently bound to C18 fatty acid
  MISC_FEATURE (29)..(29): c-term amidation
HSQGTFTSDKSKYLDERRAKDFVQWLMNT

SEQ ID NO: 945 - protein, 29 aa, Artificial Sequence
  Synthetic peptide
  MISC_FEATURE (1)..(29): Glucagon E16 K20
  MISC_FEATURE (29)..(29): c-term amidation
HSQGTFTSDYSKYLDERRAKDFVQWLMNT

SEQ ID NO: 946 - protein, 29 aa, Artificial Sequence
  Synthetic peptide
  MISC_FEATURE (1)..(29): Glucagon E16 K20 K10-W-C16 Cys 24-40K
  MOD_RES (10)..(10): Covalently bound to Trp residue comprising C16 fatty acid
  MOD_RES (24)..(24): Cys-PEG
  MISC_FEATURE (29)..(29): c-term amidation
HSQGTFTSDKSKYLDERRAKDFVCWLMNT

SEQ ID NO: 947 - protein, 29 aa, Artificial Sequence
  Synthetic peptide
  MISC_FEATURE (1)..(29): Glucagon E16 K20 K10-C18 Cys24-40K
  MOD_RES (10)..(10): Covalently bound to C18 fatty acid
  MOD_RES (24)..(24): Cys-PEG
  MISC_FEATURE (29)..(29): c-term amidation
HSQGTFTSDKSKYLDERRAKDFVCWLMNT

SEQ ID NO: 948 - protein, 29 aa, Artificial Sequence
  Synthetic peptide
  MISC_FEATURE (1)..(29): Glucagon E16 K20 K10-C18 Cys24-40K
  MOD_RES (10)..(10): Covalently bound to Trp residue comprising a C18 fatty acid
  MOD_RES (24)..(24): Cys-PEG
  MISC_FEATURE (29)..(29): c-term amidation
HSQGTFTSDKSKYLDERRAKDFVCWLMNT

SEQ ID NO: 949 - protein, 29 aa, Artificial Sequence
  Synthetic peptide
  MISC_FEATURE (1)..(29): Glucagon E16 K20 K10-C16 amide
  MOD_RES (10)..(10): Covalently bound to Glu residue comprising a C16 fatty acid
  MOD_RES (24)..(24): Cys-PEG
  MISC_FEATURE (29)..(29): c-term amidation
HSQGTFTSDKSKYLDERRAQDFVCWLMNT

SEQ ID NO: 950 - protein, 28 aa, Artificial Sequence
  Synthetic peptide
  MISC_FEATURE (1)..(28): Chimera 2 truncated by one amino acid
HSQGTFTSDYSKYLDEQAAKEFIAWLMN

SEQ ID NO: 951 - protein, 27 aa, Artificial Sequence
  Synthetic peptide
  MISC_FEATURE (1)..(27): Chimera 2 truncated by two amino acids
HSQGTFTSDYSKYLDEQAAKEFIAWLM

SEQ ID NO: 952 - protein, 28 aa, Artificial Sequence
  Synthetic peptide
  MISC_FEATURE (1)..(28): aa 1-28, E16 K20 C-terminal amide
  MISC_FEATURE (28)..(28): c-term amidation
HSQGTFTSDYSKYLDERRAKDFVQWLMN

SEQ ID NO: 953 - protein, 27 aa, Artificial Sequence
  Synthetic peptide
  MISC_FEATURE (1)..(27): aa 1-27 E16 K20 C-terminal amide
  MISC_FEATURE (27)..(27): c-term amidation
HSQGTFTSDYSKYLDERRAKDFVQWKM

SEQ ID NO: 954 - protein, 29 aa, Artificial Sequence
  Synthetic peptide
  MOD_RES (27)..(27): Norleucine
  MISC_FEATURE (29)..(29): c-term amidation
HSEGTFTSDYSKYLDEQAAKEFIAWLXNT

SEQ ID NO: 955 - protein, 39 aa, Artificial Sequence
  Synthetic peptide
  MISC_FEATURE (1)..(39): mt-138
  MISC_FEATURE (16)..(20): Lactam bridging side chains at positions 16 and 20
YSQGTFTSDYSKYLDEQAAKEFVNWLMNGGPSSGAPPPS

SEQ ID NO: 956 - protein, 29 aa, Artificial Sequence
  Synthetic peptide
  MISC_FEATURE (1)..(29): Chimera 2 with AIB at 16
  MOD_RES (16)..(16): Aminoisobutyric acid
  MISC_FEATURE (29)..(29): c-term amidation
HSQGTFTSDYSKYLDXQAAKEFIAWLMNT

SEQ ID NO: 957 - protein, 29 aa, Artificial Sequence
  Synthetic peptide
  MOD_RES (2)..(2): Aminoisobutyric acid
  MOD_RES (16)..(16): Aminoisobutyric acid
  MISC_FEATURE (29)..(29): c-term amidation
HXQGTFTSDYSKYLDXRRAQDFVQWLMNT

SEQ ID NO: 958 - protein, 29 aa, Artificial Sequence
  Synthetic peptide
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (24)..(24): Cys-PEG
  MISC_FEATURE (29)..(29): c-term amidation
HXQGTFTSDKSKYLDXRRAQDFVCWLMNT

SEQ ID NO: 959 - protein, 29 aa, Artificial Sequence
  Synthetic peptide
  MOD_RES (2)..(2): Aminoisobutric Acid
  MISC_FEATURE (10)..(10): Covalently bound to Trp residue comprising a C16 fatty acid
  MOD_RES (16)..(16): Aminoisobutric Acid
  MISC_FEATURE (29)..(29): c-term amidation
HXQGTFTSDKSKYLDXRRAQDFVCWLMNT

SEQ ID NO: 960 - protein, 29 aa, Artificial Sequence
  Synthetic peptide
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
  MOD_RES (24)..(24): Cys-PEG
  MISC_FEATURE (29)..(29): c-term amidation
HXQGTFTSDKSKYLDXRRAXDFVCWLMNT

SEQ ID NO: 961 - protein, 29 aa, Artificial Sequence
  Synthetic peptide
  MOD_RES (2)..(2): Aminoisobutyric acid
  MISC_FEATURE (10)..(10): Covalently bound to Trp residue comprising a C16 fatty acid
  MOD_RES (16)..(16): Aminoisobutyric acid
  MOD_RES (20)..(20): Aminoisobutyric acid
  MISC_FEATURE (29)..(29): c-term amidation
HXQGTFTSDKSKYLDXRRAXDFVCWLMNT

SEQ ID NO: 962 - protein, 29 aa, Artificial Sequence
  Synthetic peptide
  MOD_RES (2)..(2): Aminoisobutyric acid
  MOD_RES (16)..(16): Aminoisobutyric acid
  MISC_FEATURE (29)..(29): c-term amidation
HXQGTFTSDKSKYLDXRRAQDFVQWLMNT

SEQ ID NO: 963 - protein, 29 aa, Artificial Sequence
  Synthetic peptide
  MISC_FEATURE (1)..(29): Peptide 50
  MOD_RES (2)..(2): Aminoisobutyric Acid
  MOD_RES (10)..(10): Acylated with a C16 fatty acyl group
  MOD_RES (16)..(16): Aminoisobutyric Acid
  MISC_FEATURE (29)..(29): c-term amidation
HXQGTFTSDKSKYLDXRRAQDFVQWLMNT

SEQ ID NO: 964 - protein, 29 aa, Artificial Sequence
  Synthetic peptide
  MISC_FEATURE (1)..(29): Peptide 82
  MOD_RES (2)..(2): Aminoisobutyric Acid
  MOD_RES (10)..(10): Acylated with a C16 fatty acyl group via Ala-Ala spacer
  MOD_RES (16)..(16): Aminoisobutyric Acid
  MISC_FEATURE (29)..(29): c-term amidation
HXQGTFTSDKSKYLDXRRAQDFVQWLMNT

SEQ ID NO: 965 - protein, 29 aa, Artificial Sequence
  Synthetic peptide
  MISC_FEATURE (1)..(29): Peptide 83
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 966 - protein, 29 aa, Artificial Sequence
  Synthetic peptide
  MISC_FEATURE (1)..(29): Peptide 84
  MOD_RES (2)..(2): Aminoisobutryic Acid
  MOD_RES (10)..(10): Acylated with a C16 fatty acyl group via beta-Ala-beta-Ala spacer
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 967 - protein, 29 aa, Artificial Sequence
  Synthetic peptide
  MISC_FEATURE (1)..(29): Peptide 85
  MOD_RES (2)..(2): Aminoisobutryic Acid
  MOD_RES (10)..(10): Acylated with a C16 fatty acyl group via 6-aminohexanoic acid spacer
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 968 - protein, 29 aa, Artificial Sequence
  Synthetic peptide
  MISC_FEATURE (1)..(29): Peptide 86
  MOD_RES (2)..(2): Aminoisobutryic Acid
  MOD_RES (10)..(10): Acylated with a C16 fatty acyl group via Leu-Leu spacer
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 969 - protein, 29 aa, Artificial Sequence
  Synthetic peptide
  MISC_FEATURE (1)..(29): Peptide 87
  MOD_RES (2)..(2): Aminoisobutryic Acid
  MOD_RES (10)..(10): Acylated with a C16 fatty acyl group via Pro-Pro spacer
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 970 - protein, 29 aa, Artificial Sequence
  Synthetic peptide
  MISC_FEATURE (1)..(29): Peptide 77*
  MOD_RES (2)..(2): Aminoisobutyric Acid
  MOD_RES (10)..(10): Acylated with a C14 fatty acyl group
  MOD_RES (16)..(16): Aminoisobutyric Acid
  MOD_RES (24)..(24): Pegylated
  MISC_FEATURE (29)..(29): c-term amidation
HXQGTFTSDKSKYLDXRRAQDFVCWLMNT

SEQ ID NO: 971 - protein, 29 aa, Artificial Sequence
  Synthetic peptide
  MISC_FEATURE (1)..(29): Peptide 78*
  MOD_RES (2)..(2): Aminoisobutyric Acid
  MOD_RES (10)..(10): Acylated with a C14 fatty acyl group via gamma-Glu-gamma-Glu spacer
  MOD_RES (16)..(16): Aminoisobutyric Acid
  MOD_RES (24)..(24): Pegylated
  MISC_FEATURE (29)..(29): c-term amidation
HXQGTFTSDKSKYLDXRRAQDFVCWLMNT

SEQ ID NO: 972 - protein, 29 aa, Artificial Sequence
  Synthetic peptide
  MISC_FEATURE (1)..(29): Peptide 78
  MOD_RES (2)..(2): Aminoisobutryic Acid
  MOD_RES (10)..(10): Acylated with a C14 fatty acyl group via gamma-Glu-gamma-Glu spacer
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 973 - protein, 29 aa, Artificial Sequence
  Synthetic peptide
  MISC_FEATURE (1)..(29): Peptide 81*
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
  MOD_RES (24)..(24): Pegylated
  MISC_FEATURE (29)..(29): c-term amidation
HXQGTFTSDKSKYLDXRRAQDFVCWLMNT

SEQ ID NO: 974 - protein, 29 aa, Artificial Sequence
  Synthetic peptide
  MISC_FEATURE (1)..(29): Peptide 81
  MOD_RES (2)..(2): Aminoisobutryic Acid
  MOD_RES (10)..(10): Acylated with a C14 fatty acyl group via Ala-Ala spacer
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 975 - protein, 29 aa, Artificial Sequence
  Synthetic peptide
  MISC_FEATURE (1)..(29): Peptide 79*
  MOD_RES (2)..(2): Aminoisobutryic acid
  MOD_RES (10)..(10): Acylated with a C16 fatty acyl group via Ala-Ala spacer
  MOD_RES (16)..(16): Aminoisobutryic acid
  MOD_RES (24)..(24): Pegylated
  MISC_FEATURE (29)..(29): c-term amidation
HXQGTFTSDKSKYLDXRRAQDFVCWLMNT

SEQ ID NO: 976 - protein, 29 aa, Artificial Sequence
  Synthetic peptide
  MISC_FEATURE (1)..(29): Peptide 80*
  MOD_RES (2)..(2): Aminoisobutryic Acid
  MOD_RES (10)..(10): Acylated with a C16 fatty acyl group via gamma-Glu-gamma-Glu spacer
  MOD_RES (16)..(16): Aminoisobutryic Acid
  MOD_RES (24)..(24): Pegylated
  MISC_FEATURE (29)..(29): c-term amidation
HXQGTFTSDKSKYLDXRRAQDFVCWLMNT

SEQ ID NO: 977 - protein, 29 aa, Artificial Sequence
  Synthetic peptide
  MISC_FEATURE (1)..(29): gamma-Glu-gamma-Glu C16 Glucagon Amide
  MOD_RES (10)..(10): Acylated with a C16 fatty acyl group
  MISC_FEATURE (29)..(29): c-term amidation
HSQGTFTSDKSKYLDSRRAQDFVQWLMNT

SEQ ID NO: 978 - protein, 29 aa, Artificial Sequence
  Synthetic peptide
  MISC_FEATURE (1)..(29): gamma-Glu-gamma-Glu-C16 Glucagon Amide
  MOD_RES (10)..(10): Acylated with a C16 fatty acyl group via gamma-Glu-gamma-Glu spacer
  MISC_FEATURE (29)..(29): c-term amidation
HSQGTFTSDKSKYLDSRRAQDFVQWLMNT

SEQ ID NO: 979 - protein, 29 aa, Artificial Sequence
  Synthetic peptide
  MISC_FEATURE (1)..(29): AA-C16 Glucagon Amide
  MOD_RES (10)..(10): Acylated with a C16 fatty acyl group via Ala-Ala spacer
  MISC_FEATURE (29)..(29): c-term amidation
HSQGTFTSDKSKYLDSRRAQDFVQWLMNT

SEQ ID NO: 980 - protein, 29 aa, Artificial Sequence
  Synthetic peptide
  MISC_FEATURE (1)..(29): Chimera 2, AIB2, Lys10, Cys24-PEG
  MOD_RES (2)..(2): Aminoisobutryic Acid
  MOD_RES (24)..(24): Pegylated
  MISC_FEATURE (29)..(29): c-term amidation
HXQGTFTSDKSKYLDEQAAKEFICWLMNT

SEQ ID NO: 981 - protein, 30 aa, Artificial Sequence
  Synthetic peptide
  MISC_FEATURE (1)..(30): Peptide dS2E16K20K30-C14 Gluc Amide
  MOD_RES (2)..(2): D-Ser
  MISC_FEATURE (30)..(30): c-term amidation
  MOD_RES (30)..(30): Acylated with a C14 fatty acyl group
HXQGTFTSDYSKYLDERRAKDFVQWLMNTK

SEQ ID NO: 982 - protein, 29 aa, Artificial Sequence
  Synthetic peptide
  MISC_FEATURE (1)..(29): Peptide dS2K10(C14)E16K20-Gluc Amide
  MOD_RES (2)..(2): D-Ser
  MOD_RES (10)..(10): Acylated with a C14 fatty acyl group
  MISC_FEATURE (29)..(29): c-term amidation
HXQGTFTSDKSKYLDERRAKDFVQWLMNT

SEQ ID NO: 983 - protein, 30 aa, Artificial Sequence; identical to SEQ ID NO: 981
  Synthetic peptide
  MISC_FEATURE (1)..(30): Peptide dS2E16K20K30-C16 Gluc Amide
  MOD_RES (2)..(2): D-Ser
  MISC_FEATURE (30)..(30): c-term amidation
  MOD_RES (30)..(30): Acylated with a C16 fatty acyl group

SEQ ID NO: 984 - protein, 29 aa, Artificial Sequence
  Synthetic peptide
  MISC_FEATURE (1)..(29): Peptide dS2K10(C16)E16K20-Gluc Amide
  MOD_RES (2)..(2): D-Ser
  MOD_RES (10)..(10): Acylated with a C16 fatty acyl group
  MISC_FEATURE (29)..(29): c-term amidation
HXQGTFTSDKSKYLDERRAKDFVQWLMNT

SEQ ID NO: 985 - protein, 29 aa, Artificial Sequence
  Synthetic peptide
  MISC_FEATURE (1)..(29): Peptide Chimera 2-AIB2-K10-acylated
  MOD_RES (2)..(2): Aminoisobutryic Acid
  MOD_RES (10)..(10): Acylated with a C18 fatty acyl group
  MOD_RES (24)..(24): Pegylated
  MISC_FEATURE (29)..(29): c-term amidation
HXQGTFTSDKSKYLDEQAAKEFICWLMNT

SEQ ID NO: 986 - protein, 30 aa, Artificial Sequence
  Synthetic peptide
  MISC_FEATURE (1)..(30): Peptide Chimera 2-AIB2-K30-acylated
  MOD_RES (2)..(2): Aminoisobutryic Acid
  MOD_RES (24)..(24): Pegylated
  MISC_FEATURE (30)..(30): c-term amidation
  MOD_RES (30)..(30): Acylated with a C18 fatty acyl group
HXQGTFTSDYSKYLDEQAAKEFICWLMNTK

SEQ ID NO: 987 - protein, 29 aa, Artificial Sequence
  Synthetic peptide
  MOD_RES (1)..(1): DMIA
  MISC_FEATURE (29)..(29): c-term amidation
XSQGTFTSDYSKYLDERRAKDFVCWLMNT

SEQ ID NO: 988 - protein, 29 aa, Artificial Sequence
  Synthetic peptide
  MOD_RES (1)..(1): DMIA
  MOD_RES (16)..(20): Lactam ring between side chains of amino acids at positions 16 and 20
  MISC_FEATURE (29)..(29): c-term amidation
XSQGTFTSDYSKYLDERRAKDFVCWLMNT

SEQ ID NO: 989 - protein, 29 aa, Artificial Sequence
  Synthetic peptide
  MOD_RES (2)..(2): Aminoisobutryic Acid
  MISC_FEATURE (29)..(29): c-term amidation
HXEGTFTSDYSKYLDEQAAKEFICWLMNT

SEQ ID NO: 990 - protein, 29 aa, Artificial Sequence
  Synthetic peptide
  MOD_RES (2)..(2): Aminoisobutryic Acid
  MOD_RES (24)..(24): Pegylated
  MISC_FEATURE (29)..(29): c-term amidation
HXEGTFTSDYSKYLDEQAAKEFICWLMNT

SEQ ID NO: 991 - protein, 29 aa, Artificial Sequence
  Synthetic peptide
  MISC_FEATURE (1)..(29): Peptide J
  MOD_RES (3)..(3): Xaa is a Glutamine analog
  MOD_RES (27)..(27): Xaa is Norleucine
HSXGTFTSDYSKYLDTRRAAEFVAWLXDE

SEQ ID NO: 992 - protein, 29 aa, Artificial Sequence
  Synthetic peptide
  MISC_FEATURE (1)..(29): Peptide K
  MOD_RES (3)..(3): Xaa is a Glutamine analog
  MOD_RES (16)..(16): Xaa is Aib
HSXGTFTSDYSKYLDXRRAADFVAWLMDE

SEQ ID NO: 993 - protein, 29 aa, Artificial Sequence
  Synthetic peptide
  MOD_RES (27)..(27): Xaa is Norleucine
HSQGTFTSDYSKYLDTRRAAEFVAWLXDE

SEQ ID NO: 994 - protein, 29 aa, Artificial Sequence
  Synthetic peptide
  MOD_RES (3)..(3): Xaa is Acetamidomethyl-cysteine
  MOD_RES (27)..(27): Xaa is Norleucine
HSXGTFTSDYSKYLDTRRAAEFVAWLXDE

SEQ ID NO: 995 - protein, 29 aa, Artificial Sequence
  Synthetic peptide
  MOD_RES (3)..(3): Xaa is Acetyldiaminobutanoic acid
  MOD_RES (27)..(27): Xaa is Norleucine
HSXGTFTSDYSKYLDTRRAAEFVAWLXDE

SEQ ID NO: 996 - protein, 29 aa, Artificial Sequence
  Synthetic peptide
  MOD_RES (3)..(3): Xaa is carbamoyldiaminopropanoic acid
  MOD_RES (27)..(27): Xaa is Norleucine
HSXGTFTSDYSKYLDTRRAAEFVAWLXDE

SEQ ID NO: 997 - protein, 29 aa, Artificial Sequence
  Synthetic peptide
  MOD_RES (3)..(3): Xaa is Methylglutamine
  MOD_RES (27)..(27): Xaa is Norleucine
HSXGTFTSDYSKYLDTRRAAEFVAWLXDE

SEQ ID NO: 998 - protein, 29 aa, Artificial Sequence
  Synthetic peptide
  MOD_RES (3)..(3): Xaa is Methionine sulfoxide
  MOD_RES (27)..(27): Xaa is Norleucine
HSXGTFTSDYSKYLDTRRAAEFVAWLXDE

SEQ ID NO: 999 - protein, 29 aa, Artificial Sequence
  Synthetic peptide
  MOD_RES (3)..(3): Acetylornithine
  MOD_RES (27)..(27): Xaa is Norleucine
HSXGTFTSDYSKYLDTRRAAEFVAWLXDE

SEQ ID NO: 1000 - protein, 29 aa, Artificial Sequence
  Synthetic peptide
  MOD_RES (16)..(16): Xaa is Aminoisobutryic Acid
HSQGTFTSDYSKYLDXRRAADFVAWLMDE

SEQ ID NO: 1001 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutyric Acid
HSXGTFTSDYSKYLDXRRAADFVAWLMDE

SEQ ID NO: 1002 - protein, 29 aa, Artificial Sequence
  Synthetic peptide
  MOD_RES (3)..(3): Xaa is Methylglutamine
  MOD_RES (16)..(16): Xaa is Aminoisobutyric Acid
HSXGTFTSDYSKYLDXRRAADFVAWLMDE

SEQ ID NO: 1003 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRAADFVAWLLDE

SEQ ID NO: 1004 - protein, 39 aa, Artificial Sequence; identical to SEQ ID NO: 354
  Synthetic peptide
  MOD_RES (3)..(3): Xaa is Acetyldiaminobutanoic acid
  MOD_RES (16)..(16): Xaa is Aminoisobutyric Acid
  MISC_FEATURE (39)..(39): c-term amidation

SEQ ID NO: 1005 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRASDFVSWLLDE

SEQ ID NO: 1006 - protein, 29 aa, Artificial Sequence
  Synthetic peptide
  MOD_RES (3)..(3): Xaa is Acetyldiaminobutanoic acid
  MOD_RES (16)..(16): Xaa is Aminoisobutryic Acid
HSXGTFTSDYSKYLDXRRATDFVTWLLDE

SEQ ID NO: 1007 - protein, 29 aa, Artificial Sequence
  Synthetic peptide
  MOD_RES (1)..(1): Xaa is Dmia
  MOD_RES (10)..(10): Covalently bound to a C14 fatty acyl group
  MOD_RES (16)..(20): Lactam ring between side chains of amino acids at positions 16 and 20
  MISC_FEATURE (29)..(29): c-term amidation
XSQGTFTSDKSKYLDERRAKDFVQWLMNT

SEQ ID NO: 1008 - protein, 29 aa, Artificial Sequence
  Synthetic peptide
  MOD_RES (1)..(1): DMIA
  MOD_RES (10)..(10): Covalently bound to C16 fatty acyl group
  MOD_RES (16)..(20): Lactam ring between side chains of amino acids at positions 16 and 20
  MISC_FEATURE (29)..(29): c-term amidation
XSQGTFTSDKSKYLDERRAKDFVQWLMNT

SEQ ID NO: 1009 - protein, 29 aa, Artificial Sequence
  Synthetic peptide
  MOD_RES (1)..(1): DMIA
  MOD_RES (10)..(10): Covalently bound to C18 fatty acyl group
  MOD_RES (16)..(20): Lactam ring between side chains of amino acids at positions 16 and 20
  MISC_FEATURE (29)..(29): c-term amidation
XSQGTFTSDKSKYLDERRAKDFVQWLMNT

SEQ ID NO: 1010 - protein, 29 aa, Artificial Sequence
  Synthetic peptide
  MOD_RES (2)..(2): Aminoisobutryic Acid
  MOD_RES (10)..(10): Covalently bound to C14 fatty acyl group
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 1011 - protein, 29 aa, Artificial Sequence
  Synthetic peptide
  MOD_RES (2)..(2): Aminoisobutryic Acid
  MOD_RES (10)..(10): Covalently bound to C16 fatty acyl group
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 1012 - protein, 29 aa, Artificial Sequence
  Synthetic peptide
  MOD_RES (2)..(2): Aminoisobutryic Acid
  MOD_RES (10)..(10): Covalently bound to C18 fatty acyl group
  MOD_RES (16)..(16): Aminoisobutryic Acid
  MISC_FEATURE (29)..(29): c-term amidation
HXQGTFTSDKSKYLDXRRAQDFVQWLMNT

SEQ ID NO: 1013 - protein, 29 aa, Artificial Sequence
  Synthetic peptide
  MOD_RES (2)..(2): D-Ser
  MOD_RES (10)..(10): Covalently bound to C14 fatty acyl group
  MISC_FEATURE (29)..(29): c-term amidation
HXQGTFTSDKSKYLDERRAKDFVQWLMNT

SEQ ID NO: 1014 - protein, 29 aa, Artificial Sequence
  Synthetic peptide
  MOD_RES (2)..(2): D-Ser
  MOD_RES (10)..(10): Covalently bound to C16 fatty acyl group
  MISC_FEATURE (29)..(29): c-term amidation
HXQGTFTSDKSKYLDERRAKDFVQWLMNT

SEQ ID NO: 1015 - protein, 29 aa, Artificial Sequence
  Synthetic peptide
  MOD_RES (2)..(2): D-Ser
  MOD_RES (10)..(10): Covalently bound to a C18 fatty acyl group
  MISC_FEATURE (29)..(29): c-term amidation
HXQGTFTSDKSKYLDERRAKDFVQWLMNT

SEQ ID NO: 1016 - protein, 29 aa, Artificial Sequence
  Synthetic peptide
  MOD_RES (2)..(2): Aminoisobutyric Acid
  MOD_RES (10)..(10): Covalently bound to a C14 fatty acyl group
  MOD_RES (16)..(16): Aminoisobutyric Acid
  MISC_FEATURE (29)..(29): c-term amidation
HXQGTFTSDKSKYLDXRRAQDFVCWLMNT

SEQ ID NO: 1017 - protein, 29 aa, Artificial Sequence
  Synthetic peptide
  MOD_RES (2)..(2): Aminoisobutryic Acid
  MOD_RES (10)..(10): Covalently bound to C14 fatty acyl group via gamma-Glu-gamma-Glu spacer
  MOD_RES (16)..(16): Aminoisobutryic Acid
  MISC_FEATURE (29)..(29): c-term amidation
HXQGTFTSDKSKYLDXRRAQDFVCWLMNT

SEQ ID NO: 1018 - protein, 29 aa, Artificial Sequence
  Synthetic peptide
  MOD_RES (2)..(2): Aminoisobutryic Acid
  MOD_RES (10)..(10): Covalently bound to C14 fatty acyl group via Ala-Ala spacer
  MOD_RES (16)..(16): Aminoisobutryic Acid
  MISC_FEATURE (29)..(29): c-term amidation
HXQGTFTSDKSKYLDXRRAQDFVCWLMNT

SEQ ID NO: 1019 - protein, 29 aa, Artificial Sequence
  Synthetic peptide
  MOD_RES (2)..(2): Aminoisobutyric Acid
  MOD_RES (10)..(10): Covalently bound to C16 fatty acyl group via gamma-Glu-gamma-Glu spacer
  MOD_RES (16)..(16): Aminoisobutyric Acid
  MISC_FEATURE (29)..(29): c-term amidation
HXQGTFTSDKSKYLDXRRAQDFVCWLMNT

SEQ ID NO: 1020 - protein, 29 aa, Artificial Sequence
  Synthetic peptide
  MOD_RES (2)..(2): Aminoisobutyric Acid
  MOD_RES (10)..(10): Covalently bound to C16 fatty acyl group via Ala-Ala spacer
  MOD_RES (16)..(16): Aminoisobutyric Acid
  MISC_FEATURE (29)..(29): c-term amidation
HXQGTFTSDKSKYLDXRRAQDFVCWLMNT

SEQ ID NO: 1021 - protein, 29 aa, Artificial Sequence
  Synthetic peptide
  MOD_RES (2)..(2): Aminoisobutyric Acid
  MOD_RES (10)..(10): Covalently bound to C16 fatty acyl group
  MOD_RES (16)..(16): Aminoisobutyric Acid
  MISC_FEATURE (29)..(29): c-term amidation
HXQGTFTSDKSKYLDXRRAQDFVCWLMNT

SEQ ID NO: 1022 - protein, 30 aa, Artificial Sequence
  Synthetic peptide
  MOD_RES (2)..(2): Aminoisobutyric Acid
  MOD_RES (10)..(10): Covalently bound to C16 fatty acyl group
  MOD_RES (16)..(16): Aminoisobutyric Acid
  MISC_FEATURE (29)..(29): c-term amidation
HXQGTFTSDKSKYLDXRRAQDFVCWLMNTK

SEQ ID NO: 1023 - protein, 29 aa, Artificial Sequence
  Synthetic peptide
  MISC_FEATURE (1)..(29): beta-Ala-beta-Ala - C16 Glucagon Amide
  MISC_FEATURE (10)..(10): Acylated with a C16 fatty acyl group via beta-Ala-beta-Ala spacer
  MISC_FEATURE (29)..(29): c-term amidation
HSQGTFTSDKSKYLDSRRAQDFVQWLMNT

SEQ ID NO: 1024 - protein, 29 aa, Artificial Sequence
  Synthetic peptide
  MISC_FEATURE (1)..(29): Chimera-2 Aib2C24Mal40KPEG
  MOD_RES (2)..(2): Xaa is Aib
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 1025 - protein, 29 aa, Artificial Sequence
  Synthetic peptide
  MISC_FEATURE (1)..(29): Chimera-2 Aib2E16K20lactamC24Mal40KPEG
  MOD_RES (2)..(2): Xaa is Aib
  MISC_FEATURE (16)..(20): Lactam ring between side chains of the amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDEQAAKEFICWLMNT

SEQ ID NO: 1026 - protein, 29 aa, Artificial Sequence
  Synthetic peptide
  MISC_FEATURE (1)..(29): Glucagon Aib2E16K20lactamC24amideMal40KPEG
  MOD_RES (2)..(2): Xaa is Aib
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
HXQGTFTSDYSKYLDERRAKDFVCWLMNT

SEQ ID NO: 1027 - skipped

SEQ ID NO: 1028 - protein, 29 aa, Artificial Sequence
  Synthetic peptide
  MISC_FEATURE (1)..(29): Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MOD_RES (24)..(24): Covalently bound to 40kDa PEG via thioether made by reaction of peptide with a maleimide-activated PEG
  MOD_RES (29)..(29): AMIDATION
XSQGTFTSDYSKYLDERRAKDFVCWLMNT

SEQ ID NO: 1029 - protein, 29 aa, Artificial Sequence
  Synthetic peptide
  MISC_FEATURE (1)..(29): Glucagon Dmia1E16K20lactamC24Mal40KPEG
  MOD_RES (1)..(1): Xaa is Dmia
  MISC_FEATURE (16)..(20): Lactam ring between side chains of amino acids at positions 16 and 20
  MISC_FEATURE (24)..(24): Covalently bound to 40kDa PEG via thioether made by reaction of peptide with a maleimide-activated PEG
XSQGTFTSDYSKYLDERRAKDFVCWLMNT

SEQ ID NO: 1030 - protein, 29 aa, Artificial Sequence
  Synthetic peptide
  MISC_FEATURE (1)..(29): Glucagon Dmia1E16K20lactamC24thioether40KPEG
  MOD_RES (1)..(1): Xaa is Dmia
  MISC_FEATURE (16)..(20): Lactam ring between side chains of amino acids at position 16 and 20
  MOD_RES (24)..(24): Covalently bound to 40kDa PEG via thioether made by reaction of peptide with haloacetyl-activated PEG
  MOD_RES (29)..(29): AMIDATION
XSQGTFTSDYSKYLDERRAKDFVCWLMNT

SEQ ID NO: 1031 - protein, 29 aa, Artificial Sequence
  Synthetic peptide
  MISC_FEATURE (1)..(29): Chimera2 Aib2E3C24-Thioether40K PEG(NOF)
  MOD_RES (2)..(2): Xaa is Aib
  MOD_RES (24)..(24): Covalently bound to 40kDa PEG via thioether made by reaction of peptide with haloacetyl-activated PEG
  MOD_RES (29)..(29): AMIDATION
HXEGTFTSDYSKYLDEQAAKEFICWLMNT

SEQ ID NO: 1032 - protein, 29 aa, Artificial Sequence
  Synthetic peptide
  MOD_RES (1)..(1): Xaa is Dmia
  MOD_RES (24)..(24): Covalently bound to 40kDa PEG
  MOD_RES (29)..(29): AMIDATION
XSEGTFTSDYSKYLEERRAKDFVCWLMNT

SEQ ID NO: 1033 - protein, 29 aa, Artificial Sequence
  Synthetic peptide
  MISC_FEATURE (1)..(29): Glucagon Aib2Aib16C24K10(rErE-C16) C24PEG40K amide
  MOD_RES (2)..(2): Xaa is Aib
  MOD_RES (10)..(10): Covalently bound to C14 fatty acyl group via gamma-Glu-gamma-Glu spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 1034 - protein, 29 aa, Artificial Sequence
  Synthetic peptide
  MISC_FEATURE (1)..(29): Glucagon Aib2Aib16K10(AA-C14)C24PEG40K TE amide
  MOD_RES (2)..(2): Xaa is Aib
  MOD_RES (10)..(10): Covalently bound to C14 fatty acyl group via Ala-Ala spacer
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): AMIDATION
HXQGTFTSDKSKYLDXRRAQDFVCWLMNT

SEQ ID NO: 1035 - protein, 29 aa, Artificial Sequence
  Synthetic peptide
  MISC_FEATURE (1)..(29): Glucagon Aib2Aib16K10(AA-C16) amide
  MOD_RES (2)..(2): Xaa is Aib
  MOD_RES (10)..(10): Covalently bound to C16 fatty acyl group via Ala-Ala spacer
  MOD_RES (16)..(16): Xaa is Aib
  MOD_RES (29)..(29): AMIDATION
HXQGTFTSDKSKYLDXRRAQDFVQWLMNT

SEQ ID NO: 1036 - protein, 29 aa, Artificial Sequence
  Synthetic peptide
  MISC_FEATURE (1)..(29): Glucagon Aib2Aib16K10(rErE-C16) amide
  MOD_RES (2)..(2): Xaa is Aib
  MOD_RES (10)..(10): Covalently bound to C16 fatty acyl group via gamma-Glu-gamma-Glu spacer
  MOD_RES (16)..(16): Xaa is Aib
  MOD_RES (29)..(29): AMIDATION
HXQGTFTSDKSKYLDXRRAQDFVQWLMNT

SEQ ID NO: 1037 - protein, 29 aa, Artificial Sequence
  Synthetic peptide
  MOD_RES (2)..(2): Xaa is Aib
  MOD_RES (16)..(16): Xaa is Aib
  MOD_RES (29)..(29): AMIDATION
HXQGTFTSDYSKYLDXRRAQDFVQWLMNT

SEQ ID NO: 1038 - DNA, 20 bp, Artificial Sequence
  Synthetic primer
caaggtccagggaggttgtg

SEQ ID NO: 1039 - DNA, 24 bp, Artificial Sequence
  Synthetic primer
ccaaaggtaagctgtccataagga

SEQ ID NO: 1040 - DNA, 22 bp, Artificial Sequence
  Synthetic primer
ctctcccaagagtcacatgtcc

SEQ ID NO: 1041 - DNA, 22 bp, Artificial Sequence
  Synthetic primer
caataactcggtcccctacaac

SEQ ID NO: 1042 - protein, 29 aa, Artificial Sequence
  Synthetic peptide
HSQGTFTSDYSKYLDSRRAQDFVQWLMDT

SEQ ID NO: 1043 - protein, 29 aa, Artificial Sequence
  Synthetic peptide
  MOD_RES (2)..(2): D-Ser
  MOD_RES (10)..(10): Acylated with a C16 fatty acyl group via gamma-Glu spacer
  MISC_FEATURE (29)..(29): c-term amidation
HXQGTFTSDKSKYLDEQAAKEFIAWLMNT

SEQ ID NO: 1044 - protein, 29 aa, Artificial Sequence
  Synthetic peptide
  MOD_RES (2)..(2): D-Ser
  MOD_RES (10)..(10): Acylated with a C16 fatty acyl group via gamma-Glu-gamma-Glu spacer
  MISC_FEATURE (29)..(29): c-term amidation
HXQGTFTSDKSKYLDEQAAKEFIAWLMNT

SEQ ID NO: 1045 - protein, 29 aa, Artificial Sequence
  Synthetic peptide
  MOD_RES (2)..(2): Xaa is Aib
  MOD_RES (10)..(10): Acylated with a C16 fatty acyl group via gamma-Glu spacer
  MISC_FEATURE (29)..(29): c-term amidation
HXQGTFTSDKSKYLDEQAAKEFIAWLMNT

SEQ ID NO: 1046 - protein, 29 aa, Artificial Sequence
  Synthetic peptide
  MOD_RES (2)..(2): Xaa is Aib
  MOD_RES (10)..(10): Acylated with a C16 fatty acyl group via gamma-Glu-gamma-Glu spacer
  MISC_FEATURE (29)..(29): c-term amidation
HXQGTFTSDKSKYLDEQAAKEFIAWLMNT

SEQ ID NO: 1047 - protein, 29 aa, Artificial Sequence
  Synthetic peptide
  MOD_RES (2)..(2): Xaa is Aib
  MOD_RES (10)..(10): Acylated with a C16 fatty acyl group
  MISC_FEATURE (29)..(29): c-term amidation
HXEGTFTSDKSKYLDEQAAKEFIAWLMNT

SEQ ID NO: 1048 - protein, 29 aa, Artificial Sequence
  Synthetic peptide
  MOD_RES (2)..(2): Xaa is Aib
  MOD_RES (10)..(10): Acylated with a C16 fatty acyl group via gamma-Glu-gamma-Glu spacer
  MISC_FEATURE (29)..(29): c-term amidation
HXEGTFTSDKSKYLDEQAAKEFIAWLMNT

SEQ ID NO: 1049 - protein, 29 aa, Artificial Sequence
  Synthetic peptide
  MOD_RES (2)..(2): Xaa is Aib
  MOD_RES (10)..(10): Acylated with a C16 fatty acyl group via gamma-Glu spacer
  MISC_FEATURE (29)..(29): c-term amidation
HXQGTFISDKSKYLDEQAAKEFIAWLMNT

SEQ ID NO: 1050 - protein, 29 aa, Artificial Sequence
  Synthetic peptide
  MOD_RES (2)..(2): Xaa is Aib
  MOD_RES (10)..(10): Acylated with a C16 fatty acyl group via gamma-Glu-gamma-Glu spacer
  MISC_FEATURE (29)..(29): c-term amidation
HXQGTFISDKSKYLDEQAAKEFIAWLMNT

SEQ ID NO: 1051 - protein, 29 aa, Artificial Sequence
  Synthetic peptide
  MOD_RES (1)..(1): Xaa is Dmia
  MOD_RES (10)..(10): Acylated with a C16 fatty acyl group via gamma-Glu spacer
  MISC_FEATURE (16)..(20): Lactam ring between side chains of amino acids at positions 16 and 20
  MISC_FEATURE (29)..(29): c-term amidation
XSQGTFTSDKSKYLDERRAKDFVQWLMNT

SEQ ID NO: 1052 - protein, 29 aa, Artificial Sequence
  Synthetic peptide
  MOD_RES (1)..(1): Xaa is Dmia
  MOD_RES (10)..(10): Acylated with a C16 fatty acyl group via gamma-Glu-gamma-Glu spacer
  MISC_FEATURE (16)..(20): Lactam ring between side chains of amino acids at positions 16 and 20
  MISC_FEATURE (29)..(29): c-term amidation
XSQGTFTSDKSKYLDERRAKDFVQWLMNT

SEQ ID NO: 1053 - protein, 29 aa, Artificial Sequence
  Synthetic peptide
  MOD_RES (1)..(1): Xaa is Dmia
  MISC_FEATURE (16)..(20): Lactam ring between side chains of amino acids at positions 16 and 20
  MISC_FEATURE (29)..(29): c-term amidation
  MOD_RES (29)..(29): Acylated with a C16 fatty acyl group via gamma-Glu spacer
XSQGTFTSDYSKYLDERRAKDFVQWLMNK

SEQ ID NO: 1054 - protein, 29 aa, Artificial Sequence
  Synthetic peptide
  MOD_RES (1)..(1): Xaa is Dmia
  MISC_FEATURE (16)..(20): Lactam ring between side chains of amino acids at positions 16 and 20
  MISC_FEATURE (29)..(29): c-term amidation
  MOD_RES (29)..(29): Acylated with a C16 fatty acyl group via gamma-Glu-gamma-Glu spacer
XSQGTFTSDYSKYLDERRAKDFVQWLMNK

SEQ ID NO: 1055 - protein, 29 aa, Artificial Sequence
  Synthetic peptide
  MOD_RES (2)..(2): Xaa is Aib
  MOD_RES (10)..(10): Acylated with a C16 fatty acyl group via gamma-Glu-gamma-Glu spacer
  MOD_RES (16)..(16): Xaa is Aib
  MISC_FEATURE (29)..(29): c-term amidation
HXQGTFTSDKSKYLDXRAAQDFVQWLMDT

SEQ ID NO: 1056 - protein, 29 aa, Artificial Sequence
  Synthetic peptide
  MOD_RES (2)..(2): Xaa is Aib
  MOD_RES (10)..(10): Acylated with a C16 fatty acyl group via gamma-Glu spacer
  MOD_RES (16)..(16): Xaa is Aib
  MISC_FEATURE (29)..(29): c-term amidation
HXQGTFTSDKSKYLDXRAAQDFVQWLMDT

SEQ ID NO: 1057 - protein, 40 aa, Artificial Sequence; identical to SEQ ID NO: 265
  Synthetic peptide
  MISC_FEATURE (1)..(40): MT-345
  MOD_RES (2)..(2): Xaa is Aib
  MOD_RES (29)..(29): Acylated with a C14 fatty acyl group
  MOD_RES (40)..(40): AMIDATION

SEQ ID NO: 1058 - protein, 40 aa, Artificial Sequence; identical to SEQ ID NO: 265
  Synthetic peptide
  MISC_FEATURE (1)..(40): MT-346
  MOD_RES (2)..(2): Xaa is Aib
  MOD_RES (40)..(40): AMIDATION

SEQ ID NO: 1059 - protein, 40 aa, Artificial Sequence
  Synthetic peptide
  MISC_FEATURE (1)..(40): MT-347
  MOD_RES (2)..(2): Xaa is Aib
  MOD_RES (16)..(16): Xaa is Aib
  MOD_RES (29)..(29): Acylated with a C14 fatty acyl group
  MOD_RES (40)..(40): AMIDATION
HXQGTFTSDYSKYLDXQAAKEFICWLMNGGPSSGAPPPSK

SEQ ID NO: 1060 - protein, 40 aa, Artificial Sequence; identical to SEQ ID NO: 1059
  Synthetic peptide
  MISC_FEATURE (1)..(40): MT-348
  MOD_RES (2)..(2): Xaa is Aib
  MOD_RES (16)..(16): Xaa is Aib
  MOD_RES (40)..(40): AMIDATION

SEQ ID NO: 1061 - protein, 40 aa, Artificial Sequence; identical to SEQ ID NO: 265
  Synthetic peptide
  MISC_FEATURE (1)..(40): MT-349
  MOD_RES (2)..(2): Xaa is Aib
  MOD_RES (24)..(24): Covalently bound to 40kDa PEG via thioether made by reaction of peptide with haloacetyl-activated PEG
  MOD_RES (29)..(29): Acylated with a C14 fatty acyl group
  MOD_RES (40)..(40): AMIDATION

SEQ ID NO: 1062 - protein, 40 aa, Artificial Sequence; identical to SEQ ID NO: 265
  Synthetic peptide
  MISC_FEATURE (1)..(40): MT-350
  MOD_RES (2)..(2): Xaa is Aib
  MOD_RES (24)..(24): Covalently bound to 40kDa PEG via thioether made by reaction of peptide with haloacetyl-activated PEG
  MOD_RES (40)..(40): AMIDATION

SEQ ID NO: 1063 - protein, 40 aa, Artificial Sequence; identical to SEQ ID NO: 1059
  Synthetic peptide
  MISC_FEATURE (1)..(40): MT-351
  MOD_RES (2)..(2): Xaa is Aib
  MOD_RES (16)..(16): Xaa is Aib
  MOD_RES (24)..(24): Covalently bound to 40kDa PEG via thioether made by reaction of peptide with haloacetyl-activated PEG
  MOD_RES (29)..(29): Acylated with a C14 fatty acyl group
  MOD_RES (40)..(40): AMIDATION

SEQ ID NO: 1064 - protein, 40 aa, Artificial Sequence; identical to SEQ ID NO: 1059
  Synthetic peptide
  MISC_FEATURE (1)..(40): MT-352
  MOD_RES (2)..(2): Xaa is Aib
  MOD_RES (16)..(16): Xaa is Aib
  MOD_RES (24)..(24): Covalently bound to 40kDa PEG via thioether made by reaction of peptide with haloacetyl-activated PEG
  MOD_RES (40)..(40): AMIDATION

SEQ ID NO: 1065 - skipped

SEQ ID NO: 1066 - protein, 40 aa, Artificial Sequence
  Synthetic peptide
  MISC_FEATURE (1)..(40): MT-361
  MOD_RES (2)..(2): Xaa is Aib
  MOD_RES (16)..(16): Xaa is Aib
  MOD_RES (40)..(40): AMIDATION
HXQGTFTSDYSIYLDXQAAKEFVNWLMNGGPSSGAPPPSK

SEQ ID NO: 1067 - protein, 40 aa, Artificial Sequence; identical to SEQ ID NO: 1066
  Synthetic peptide
  MISC_FEATURE (1)..(40): MT-362
  MOD_RES (2)..(2): Xaa is Aib
  MOD_RES (16)..(16): Xaa is Aib
  MOD_RES (29)..(29): Acylated with a C16 fatty acyl group
  MOD_RES (40)..(40): AMIDATION

SEQ ID NO: 1068 - protein, 40 aa, Artificial Sequence
  Synthetic peptide
  MISC_FEATURE (1)..(40): MT-363
  MOD_RES (2)..(2): Xaa is Aib
  MOD_RES (40)..(40): AMIDATION
HXQGTFTSDYSKYLDEQAAKEFIAWLMNGGPSSGAPPPSK

SEQ ID NO: 1069 - protein, 40 aa, Artificial Sequence; identical to SEQ ID NO: 1068
  Synthetic peptide
  MISC_FEATURE (1)..(40): MT-364
  MOD_RES (2)..(2): Xaa is Aib
  MOD_RES (29)..(29): Acylated with a C16 fatty acyl group
  MOD_RES (40)..(40): AMIDATION

SEQ ID NO: 1070 - protein, 40 aa, Artificial Sequence; identical to SEQ ID NO: 36
  Synthetic polypeptide
  MISC_FEATURE (1)..(40): MT-261
  MOD_RES (2)..(2): Xaa is Aib
  MOD_RES (20)..(20): Xaa is Aib
  MOD_RES (29)..(29): Acylated with a C16 fatty acyl group
  MOD_RES (40)..(40): AMIDATION

SEQ ID NO: 1071 - protein, 40 aa, Artificial Sequence; identical to SEQ ID NO: 223
  Synthetic polypeptide
  MISC_FEATURE (1)..(40): mt-278
  MOD_RES (2)..(2): Xaa is Aib
  MOD_RES (20)..(20): Xaa is Aib
  MOD_RES (29)..(29): Acylated with a C16 fatty acyl group
  MOD_RES (40)..(40): AMIDATION

SEQ ID NO: 1072 - protein, 40 aa, Artificial Sequence; identical to SEQ ID NO: 242
  Synthetic polypeptide
  MISC_FEATURE (1)..(40): MT-297
  MOD_RES (2)..(2): Xaa is Aib
  MOD_RES (20)..(20): Xaa is Aib
  MOD_RES (29)..(29): Acylated with a C16 fatty acyl group
  MOD_RES (40)..(40): AMIDATION

SEQ ID NO: 1073 - protein, 40 aa, Artificial Sequence; identical to SEQ ID NO: 333
  Synthetic polypeptide
  MISC_FEATURE (1)..(40): MT-358
  MOD_RES (2)..(2): Xaa is Aib
  MOD_RES (20)..(20): Xaa is Aib
  MOD_RES (29)..(29): Acylated with a C16 fatty acyl group
  MOD_RES (40)..(40): AMIDATION

SEQ ID NO: 1074 - protein, 11 aa, Artificial Sequence
  Synthetic peptide
  misc_feature (1)..(1): Xaa can be any naturally occurring amino acid
XGPSSGAPPPS

SEQ ID NO: 1075 - protein, 42 aa, Homo sapiens; identical to SEQ ID NO: 2
  PEPTIDE (1)..(42): gastric inhibitory polypeptide

SEQ ID NO: 1076-1100 - skipped (25 entries)

SEQ ID NO: 1101 - protein, 29 aa, Homo sapiens
HSQGTFTSDYSKYLDSRRAQDFVQWLMNT

SEQ ID NO: 1102 - protein, 28 aa, Artificial Sequence
  Synthetic Polypeptide
  MISC_FEATURE (1)..(40): Glucagon analogue
  MISC_FEATURE (8)..(8): Xaa is aspartic acid, glutamic acid, cysteic acid or homocysteic acid
SQGTFTSXYSKYLDSRRAQDFVQWLMNT

SEQ ID NO: 1103 - protein, 27 aa, Artificial Sequence
  Synthetic Polypeptide
  MISC_FEATURE (1)..(27): Glucagon analogue
  MISC_FEATURE (7)..(7): Xaa is aspartic acid, glutamic acid, cysteic acid or homocysteic acid
QGTFTSXYSKYLDSRRAQDFVQWLMNT

SEQ ID NO: 1104 - protein, 26 aa, Artificial Sequence
  Synthetic Polypeptide
  MISC_FEATURE (1)..(26): Glucagon analogue
  MISC_FEATURE (6)..(6): Xaa is aspartic acid, glutamic acid, cysteic acid or homocysteic acid
GTFTSXYSKYLDSRRAQDFVQWLMNT

SEQ ID NO: 1105 - protein, 25 aa, Artificial Sequence
  Synthetic Polypeptide
  MISC_FEATURE (1)..(25): Glucagon analogue
  MISC_FEATURE (5)..(5): Xaa is aspartic acid, glutamic acid, cysteic acid or homocysteic acid
TFTSXYSKYLDSRRAQDFVQWLMNT

SEQ ID NO: 1106 - protein, 24 aa, Artificial Sequence
  Synthetic Polypeptide
  MISC_FEATURE (1)..(24): Glucagon analogue
  MISC_FEATURE (4)..(4): Xaa is glutamic acid, cysteic acid or homocysteic acid
  MISC_FEATURE (22)..(22): Xaa at position 22 is Met, Leu or Nle
FTSXYSKYLDSRRAQDFVQWLXNT

SEQ ID NO: 1107 - protein, 24 aa, Artificial Sequence
  Synthetic Polypeptide
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNT

SEQ ID NO: 1108 - protein, 24 aa, Artificial Sequence
  Synthetic Polypeptide
  MOD_RES (1)..(1): N-terminal amino group replaced with hydroxy group
  MISC_FEATURE (22)..(22): Xaa is  Met, Leu or Nle
  MOD_RES (24)..(24): C-terminal alpha carboxylate replaced with amide
FTSDYSRYLDSRRAQDFVQWLXNT

SEQ ID NO: 1109 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenyalanine
  MISC_FEATURE (22)..(22): Xaa is Met, Leu or Nle
FTSXYSXYLDXRRAQDFVQWLXNT

SEQ ID NO: 1110 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNT

SEQ ID NO: 1111 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDSRRAQDFVXWLXNT

SEQ ID NO: 1112 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (11)..(11): Xaa is Lys, Cys, Orn, homocysteine or acetyl phenylalanine
  MISC_FEATURE (19)..(19): Xaa is Lys, Cys, Orn, homocysteine or acetyl phenylalanine
  MISC_FEATURE (22)..(22): Xaa is Met, Leu or Nle
FTSXYSXYLDXRRAQDFVXWLXNT

SEQ ID NO: 1113 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVQWLXNT

SEQ ID NO: 1114 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSKYLDSRRAQDFVCWLXNT

SEQ ID NO: 1115 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): Pegylated
FTSXYSKYLDSRRAQDFVQWLXNC

SEQ ID NO: 1116 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (19)..(19): Pegylated
  MISC_FEATURE (22)..(22): Xaa is Met, Leu or Nle
FTSXYSRYLDSRRAQDFVKWLXNT

SEQ ID NO: 1117 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MOD_RES (11)..(11): Pegylated
  MISC_FEATURE (22)..(22): Xaa is Met, Leu or Nle
FTSXYSKYLDCRRAQDFVCWLXNT

SEQ ID NO: 1118 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MOD_RES (24)..(24): C-terminal alpha carboxylate replaced with amide
FTSXYSKYLECRRAQDFVQWLXNT

SEQ ID NO: 1119 - protein, 10 aa, Artificial Sequence
  Synthetic Polypeptide
  MISC_FEATURE (1)..(10): Peptide fragment representing the carboxy terminal 10 amino acids of Exendin-4
GPSSGAPPPS

SEQ ID NO: 1120 - protein, 8 aa, Artificial Sequence
  Synthetic Polypeptide
  MISC_FEATURE (1)..(8): Peptide fragment representing the carboxy terminal 8 amino acids of oxyntomodulin
KRNRNNIA

SEQ ID NO: 1121 - protein, 4 aa, Artificial Sequence
  Synthetic Polypeptide
  MISC_FEATURE (1)..(4): Peptide fragment representing the carboxy 4 amino acids of oxyntomodulin carboxy terminus
KRNR

SEQ ID NO: 1122 - protein, 24 aa, Artificial Sequence
  Synthetic Polypeptide
  MISC_FEATURE (1)..(24): Glucagon analogue
  MISC_FEATURE (7)..(7): Xaa is Lys or Arg
  MISC_FEATURE (11)..(11): Xaa is Lys, Cys, Orn, homocycstein or acetyl phenyalanine
  MISC_FEATURE (19)..(19): Xaa is Lys, Cys, Orn, homocycstein or acetyl phenyalanine
FTSRYSXYLDXRRAQDFVXWLMNT

SEQ ID NO: 1123 - protein, 34 aa, Artificial Sequence
  Synthetic Polypeptide
  MISC_FEATURE (1)..(34): Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MISC_FEATURE (22)..(22): Xaa is Met, Leu or Nle
FTSXYSXYLDSRRAQXFVQWLXNTGPSSGAPPPS

SEQ ID NO: 1124 - protein, 32 aa, Artificial Sequence
  Synthetic Polypeptide
  MISC_FEATURE (1)..(32): Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNRNNIA

SEQ ID NO: 1125 - protein, 34 aa, Artificial Sequence
  Synthetic Polypeptide
  MISC_FEATURE (1)..(34): Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTGPSSGAPPPS

SEQ ID NO: 1126 - protein, 32 aa, Artificial Sequence
  Synthetic Polypeptide
  MISC_FEATURE (1)..(32): Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylation
  MISC_FEATURE (22)..(22): Xaa is Met, Leu or Nle
FTSXYSXYLDSRRAQXFVQWLXNTKRNRNNIA

SEQ ID NO: 1127 - protein, 28 aa, Artificial Sequence
  Synthetic Polypeptide
  MISC_FEATURE (1)..(28): Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (16)..(16): Xaa is Lys, Cys, Orn, homocysteine or acetyl phenylalanine
  MOD_RES (16)..(16): Pegylated
  MISC_FEATURE (22)..(22): Xaa is Met, Leu or Nle
FTSXYSXYLDSRRAQXFVQWLXNTKRNR

SEQ ID NO: 1128 - protein, 28 aa, Artificial Sequence
  Synthetic Polypeptide
  MISC_FEATURE (1)..(28): Glucagon analogue
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDSRRAQDFVXWLXNTKRNR

SEQ ID NO: 1129 - protein, 34 aa, Artificial Sequence
  Synthetic Polypeptide
  MISC_FEATURE (1)..(34): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTGPSSGAPPPS

SEQ ID NO: 1130 - protein, 32 aa, Artificial Sequence
  Synthetic Polypeptide
  MISC_FEATURE (1)..(32): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQDFVQWLXNTKRNRNNIA

SEQ ID NO: 1131 - protein, 28 aa, Artificial Sequence
  Synthetic Polypeptide
  MISC_FEATURE (1)..(28): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLDSRRAQCFVQWLXNTKRNR

SEQ ID NO: 1132 - protein, 29 aa, Artificial Sequence
  Synthetic Polypeptide
  MISC_FEATURE (1)..(29): Glucagon analogue
HSQGTFTSDYSKYLDSCRAQDFVQWLMNT

SEQ ID NO: 1133 - protein, 39 aa, Artificial Sequence; identical to SEQ ID NO: 436
  Synthetic Polypeptide
  MISC_FEATURE (1)..(39): Glucagon analogue

SEQ ID NO: 1134 - protein, 29 aa, Artificial Sequence
  Synthetic Polypeptide
  MISC_FEATURE (1)..(29): Glucagon analogue
  MOD_RES (24)..(24): 2-butyrolactone bound through thiol group of Cysteine
HSQGTFTSDYSKYLDSRRAQCFVQWLMNT

SEQ ID NO: 1135 - protein, 29 aa, Artificial Sequence
  Synthetic Polypeptide
  MISC_FEATURE (1)..(29): Glucagon Analogue
  MOD_RES (24)..(24): Carboxymethyl group bound through thiol group of Cysteine
HSQGTFTSDYSKYLDSRRAQCFVQWLMNT

SEQ ID NO: 1136 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
FTSXYSKYLESRRAQDFVQWLXNT

SEQ ID NO: 1137 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (22)..(22): Xaa is Met, Leu or Nle
FTSDYSKYLDSRRAQDFVQWLXNT

SEQ ID NO: 1138 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (22)..(22): Xaa is Met, Leu or Nle
FTSDYSKYLESRRAQDFVQWLXNT

SEQ ID NO: 1139 - protein, 24 aa, Artificial Sequence
  Synthetic Polypeptide
  MISC_FEATURE (1)..(24): Glucagon analogue
  MISC_FEATURE (1)..(1): N-terminal amino group replaced with hydroxy group
  MISC_FEATURE (4)..(4): Xaa is aspartic acid, glutamic acid, cysteic acid or homocysteic acid
  MISC_FEATURE (22)..(22): Xaa is Met, Leu or Nle
  MISC_FEATURE (23)..(23): Xaa is Asn, Asp, Glu, cysteic acid or homocysteic acid
  MISC_FEATURE (24)..(24): Xaa id Thr, Asp, Glu, cysteic acid or homocysteic acid
FTSXYSKYLDSRRAQDFVQWLXXX

SEQ ID NO: 1140 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1141 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn, Asp or Glu
  MISC_FEATURE (24)..(24): Xaa is Thr, glu or Asp
FTSXYSKYLXSRRAQDFVQWLXXX

SEQ ID NO: 1142 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVQWLXXX

SEQ ID NO: 1143 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (11)..(11): 20kDa PEG group attached to Xaa at position 11
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXCRRAQDFVQWLXXX

SEQ ID NO: 1144 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (16)..(16): 20kDa PEG group attached to Xaa at position 16
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQCFVQWLXXX

SEQ ID NO: 1145 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MOD_RES (19)..(19): Pegylated
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
FTSXYSKYLXSRRAQDFVCWLXXX

SEQ ID NO: 1146 - protein, 35 aa, Artificial Sequence
  Synthetic Polypeptide
  MISC_FEATURE (1)..(35): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (25)..(25): Xaa is Lys, Cys, Orn, homocycstein or acetyl phenyalanine
  MOD_RES (25)..(25): Pegylated
FTSXYSKYLXSRRAQDFVQWLXXXXGPSSGAPPPS

SEQ ID NO: 1147 - protein, 35 aa, Artificial Sequence
  Synthetic Polypeptide
  MISC_FEATURE (1)..(35): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn or an acidic amino acid
  MISC_FEATURE (24)..(24): Xaa is Thr or an acidic amino acid
  MISC_FEATURE (35)..(35): Xaa is Lys, Cys, Orn, homocysteine or acetyl phenyalanine
  MOD_RES (35)..(35): Pegylated
FTSXYSKYLXSRRAQDFVQWLXXXGPSSGAPPPSX

SEQ ID NO: 1148 - protein, 39 aa, Artificial Sequence; identical to SEQ ID NO: 439
  Synthetic Polypeptide
  MISC_FEATURE (1)..(39): Glucagon analogue

SEQ ID NO: 1149 - protein, 35 aa, Artificial Sequence
  Synthetic Polypeptide
  MISC_FEATURE (1)..(35): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (22)..(22): Xaa is Met , Leu or Nle
  MISC_FEATURE (35)..(35): Xaa is Lys, Cys, Orn, homocysteine or acetyl phenyalanine
  MOD_RES (35)..(35): Pegylated
FTSXYSXYLDSRRAQDFVQWLXNTGPSSGAPPPSX

SEQ ID NO: 1150 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
FTSEYSKYLDSRRAQDFVQWLMNT

SEQ ID NO: 1151 - protein, 20 aa, Artificial Sequence
  Synthetic Polypeptide
  MISC_FEATURE (1)..(20): Glucagon analogue
YSKYLDSRRAQDFVQWLMNT

SEQ ID NO: 1152 - protein, 24 aa, Artificial Sequence
  Synthetic Polypeptide
  MISC_FEATURE (1)..(24): Glucagon analogue
  MISC_FEATURE (4)..(4): Xaa is Homocysteic acid
FTSXYSKYLDSRRAQDFVQWLMNT

SEQ ID NO: 1153 - protein, 11 aa, Artificial Sequence
  Synthetic Polypeptide
  MISC_FEATURE (1)..(11): Peptide fragment representing the carboxy terminal 10 amino acids of Exendin-4
  MISC_FEATURE (11)..(11): Xaa is Lys, Cys, Orn, homocysteine or acetyl phenyalanine
GPSSGAPPPSX

SEQ ID NO: 1154 - protein, 6 aa, Artificial Sequence
  Synthetic Polypeptide
  MISC_FEATURE (6)..(6): Xaa is phenyl lactic acid
HSQGTX

SEQ ID NO: 1155 - protein, 5 aa, Artificial Sequence
  Synthetic Polypeptide
  MISC_FEATURE (5)..(5): Xaa is phenyl lactic acid
SQGTX

SEQ ID NO: 1156 - protein, 4 aa, Artificial Sequence
  Synthetic Polypeptide
  MISC_FEATURE (4)..(4): Xaa is phenyl lactic acid
QGTX

SEQ ID NO: 1157 - protein, 3 aa, Artificial Sequence
  Synthetic Polypeptide
  MISC_FEATURE (3)..(3): Xaa is phenyl lactic acid
GTX

SEQ ID NO: 1158 - protein, 2 aa, Artificial Sequence
  Synthetic Polypeptide
  MISC_FEATURE (2)..(2): Xaa is phenyl lactic acid
TX

SEQ ID NO: 1159 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1160 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1161 - protein, 4 aa, Artificial Sequence
  Synthetic Polypeptide
  MISC_FEATURE (1)..(1): Xaa is selected from a group consisting of Glu and Gln
  MISC_FEATURE (4)..(4): Xaa is phenyl lactic acid
XGTX

SEQ ID NO: 1162 - protein, 24 aa, Artificial Sequence
  Synthetic Polypeptide
  MISC_FEATURE (1)..(24): Peptide AL
  MOD_RES (1)..(1): N-terminal amino group replaced with hydroxy group
  MOD_RES (24)..(24): C-terminal alpha carboxylate optionally replaced with amide
FTSDYSKYLDSRRAQDFVQWLMDT

SEQ ID NO: 1163 - protein, 28 aa, Artificial Sequence
  Synthetic Polypeptide
  MISC_FEATURE (1)..(28): Peptide AM
  MOD_RES (28)..(28): C-terminal alpha carboxylate optionally replaced with amide
SQGTFTSEYSKYLDSRRAQDFVQWLMNT

SEQ ID NO: 1164 - protein, 28 aa, Artificial Sequence
  Synthetic Polypeptide
  MISC_FEATURE (1)..(28): Peptide AN
  MISC_FEATURE (4)..(5): Threonine in position 4 and phenyl lactic acid in position 5 linked via ester bond
  MISC_FEATURE (5)..(5): Xaa is phenyl lactic acid
  MOD_RES (28)..(28): Optional C-terminal alpha carboxylate replaced with amide
  MOD_RES (28)..(28): C-terminal alpha carboxylate optionally replaced with amide
SQGTXTSEYSKYLDSRRAQDFVQWLMNT

SEQ ID NO: 1165 - protein, 29 aa, Artificial Sequence
  Synthetic Polypeptide
  MISC_FEATURE (1)..(29): Peptide AO
  MISC_FEATURE (5)..(6): Threonine in position 5 and phenyl lactic acid in position 6 linked via ester bond
  MISC_FEATURE (6)..(6): Xaa is phenyl lactic acid
  MOD_RES (29)..(29): C-terminal alpha carboxylate optionally replaced with amide
HSQGTXTSEYSKYLDSRRAQDFVQWLMNT

SEQ ID NO: 1166 - protein, 24 aa, Artificial Sequence
  Synthetic Polypeptide
  MISC_FEATURE (1)..(24): Peptide AQ
  MOD_RES (1)..(1): N-terminal amino group replaced with hydroxy group
  MISC_FEATURE (11)..(11): Xaa is amino isobutyric acid
FTSDYSKYLDXRRAQDFVQWLMNT

SEQ ID NO: 1167 - protein, 24 aa, Artificial Sequence
  Synthetic Polypeptide
  MISC_FEATURE (1)..(24): Peptide AT
  MOD_RES (1)..(1): N-terminal amino group replaced with hydroxy group
FTSDYSKYLDERRAQDFVQWLMNT

SEQ ID NO: 1168 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
XXXTGF

SEQ ID NO: 1169 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
XXTGF

SEQ ID NO: 1170 - protein, 4 aa, Artificial Sequence
  Synthetic Polypeptide
  MISC_FEATURE (1)..(1): Xaa is selected from a group consisting of Glu or Gln
XTGF

SEQ ID NO: 1171 - protein, 24 aa, Artificial Sequence
  Synthetic Polypeptide
  MOD_RES (1)..(1): N-terminal amino group replaced with hydroxy group
  MISC_FEATURE (24)..(24): C-terminal alpha carboxylate optionally replaced with an amide
FTSEYSKYLDSRRAQDFVQWLMNT

SEQ ID NO: 1172-1200 - skipped (29 entries)

SEQ ID NO: 1201 - protein, 29 aa, Homo sapiens
HSQGTFTSDYSKYLDSRRAQDFVQWLMNT

SEQ ID NO: 1202 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
FTSDYSKYLDSRRAQDFVQWLMNT

SEQ ID NO: 1203 - protein, 31 aa, Homo sapiens; identical to SEQ ID NO: 102

SEQ ID NO: 1204 - protein, 30 aa, Homo sapiens; identical to SEQ ID NO: 103

SEQ ID NO: 1205 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
FTSDYSKYLDERRAQDFVQWLMNT

SEQ ID NO: 1206 - protein, 24 aa, Artificial Sequence
  Synthetic Polypeptide
  MOD_RES (1)..(1): N-terminal amino group replaced with hydroxy group
FTSDYSKYLDERRAKDFVQWLMNT

SEQ ID NO: 1207 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (11)..(11): Xaa is Ser or Glu
FTSDYSKYLDXRRAKDFVEWLMNT

SEQ ID NO: 1208 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (11)..(11): Xaa is Ser or Glu
FTSDYSKYLDXRRAQDFVEWLMKT

SEQ ID NO: 1209 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (7)..(7): Xaa at position 7 is Lys or Glu
  MISC_FEATURE (10)..(10): Xaa is Asp, Glu, homoglutamic acid, cysteic acid or homocysteic acid
  MISC_FEATURE (11)..(11): Xaa is Ala, Ser, Glu, Lys, homoglutamic acid or homocysteic acid
  MISC_FEATURE (15)..(15): Xaa is Gln, Glu or Lys
  MISC_FEATURE (19)..(19): Xaa is Ala, Gln, Lys or Glu
  MISC_FEATURE (23)..(23): Xaa is Asn, Lys or an acidic amino acid
  MISC_FEATURE (24)..(24): Xaa is Thr or an acidic amino acid
FTSDYSXYLXXRRAXDFVXWLMXX

SEQ ID NO: 1210 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
  MISC_FEATURE (19)..(19): Xaa is Ala, Gln or Glu
  MISC_FEATURE (23)..(23): Xaa is Asn, Lys or an acidic amino acid
FTSDYSKYLDXRRAXDFVXWLMXT

SEQ ID NO: 1211 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (11)..(11): Xaa is Ala, Ser, Glu, Gln, homoglutamic acid or homocysteic acid
  MISC_FEATURE (15)..(15): Xaa is Gln or Lys
FTSDYSKYLDXRRAXDFVQWLMNT

SEQ ID NO: 1212 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Arg
  MISC_FEATURE (15)..(15): Xaa is Lys or Gln
  MISC_FEATURE (16)..(16): Xaa is Lys, Cys, Orn, homocysteine or acetyl phenyalanine
  MOD_RES (16)..(16): Pegylated
  MISC_FEATURE (19)..(19): Xaa is Lys, Cys, Orn, homocysteine or acetyl phenylalanine
  MOD_RES (19)..(19): Pegylated
  MISC_FEATURE (22)..(22): Xaa is Met, Leu or Nle
FTSXYSXYLDERRAXXFVXWLXNT

SEQ ID NO: 1213 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (16)..(16): Xaa is Cys, Orn, homocysteine or acetyl phenyalanine
  MOD_RES (16)..(16): Pegylated
  MISC_FEATURE (22)..(22): Xaa is Met, Leu or Nle
FTSXYSKYLDERRAXXFVQWLXNT

SEQ ID NO: 1214 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (15)..(15): Xaa is Lys or Gln
  MISC_FEATURE (19)..(19): Xaa is Cys, Orn, homocysteine or acetyl phenylalanine
  MOD_RES (19)..(19): Pegylated
  MISC_FEATURE (22)..(22): Xaa is Met, Leu or Nle
FTSXYSKYLDERRAXDFVXWLXNT

SEQ ID NO: 1215 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr or an acidic amino acid
FTSXYSXYLXXRRAXDFVXWLXXX

SEQ ID NO: 1216 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAQDFVQWLXXT

SEQ ID NO: 1217 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXERRAKDFVQWLXXT

SEQ ID NO: 1218 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (15)..(19): Lactam bridge connecting residues 15 and 19
  MISC_FEATURE (22)..(22): Xaa is Met, Leu or Nle
  MISC_FEATURE (23)..(23): Xaa is Asn, Asp or Glu
  MOD_RES (24)..(24): C-terminal alpha carboxylate replaced with amide
FTSDYSKYLXXRRAKDFVEWLXXT

SEQ ID NO: 1219 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (10)..(10): Xaa is Asp or Glu
  MISC_FEATURE (11)..(11): Xaa is Ser or Glu
  MISC_FEATURE (19)..(23): Lactam bridge connecting residues 19 and 23
  MISC_FEATURE (22)..(22): Xaa is Met, Leu or Nle
  MISC_FEATURE (24)..(24): Xaa is Thr or Glu
  MOD_RES (24)..(24): C-terminal alpha carboxylate replaced with amide
FTSDYSKYLXXRRAQDFVEWLXKX

SEQ ID NO: 1220 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteine
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys, Asp, Glu, cysteic acid or homocysteic acid
  MISC_FEATURE (24)..(24): Xaa is Thr, Asp, Glu, cysteic acid and homocysteic acid
FTSXYSXYLXXRRAXDFVXWLXXX

SEQ ID NO: 1221 - protein, 10 aa, Artificial Sequence
  Synthetic Polypeptide
  MISC_FEATURE (1)..(10): Peptide fragment representing the carboxy terminal 10 amino acids of Exendin-4
GPSSGAPPPS

SEQ ID NO: 1222 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid and homocysteic acid
  MISC_FEATURE (22)..(22): Xaa is Met, Leu or Nle
FTSXYSKYLXERRAQDFVQWLXNT

SEQ ID NO: 1223 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (11)..(15): Lactam bridge connecting residues 11 and 15
  MISC_FEATURE (22)..(22): Xaa is Met, Leu or Nle
FTSXYSKYLXERRAKDFVQWLXNT

SEQ ID NO: 1224 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (15)..(19): Lactam bridge connecting residues 15 and 19
  MISC_FEATURE (22)..(22): Xaa is Met, Leu or Nle
FTSXYSKYLXERRAKDFVEWLXNT

SEQ ID NO: 1225 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid and homocysteic acid
  MISC_FEATURE (19)..(24): Lactam bridge connecting residues 19 and 24
  MISC_FEATURE (22)..(22): Xaa is Met, Leu or Nle
FTSXYSKYLXERRAQDFVEWLXKT

SEQ ID NO: 1226 - protein, 8 aa, Artificial Sequence
  Synthetic Polypeptide
  MISC_FEATURE (1)..(8): Peptide fragment representing the carboxy terminal 8 amino acids of oxyntomodulin
KRNRNNIA

SEQ ID NO: 1227 - protein, 4 aa, Artificial Sequence
  Synthetic Polypeptide
  MISC_FEATURE (1)..(4): Peptide fragment representing the carboxy 4 amino acids of oxyntomodulin carboxy terminus
KRNR

SEQ ID NO: 1228 - protein, 34 aa, Artificial Sequence
  Synthetic Polypeptide
  MISC_FEATURE (1)..(34): Glucagon analogue
FTSEYSKYLDERRAQDFVQWLMNTGPSSGAPPPS

SEQ ID NO: 1229 - protein, 34 aa, Artificial Sequence; identical to SEQ ID NO: 1228
  Synthetic Polypeptide
  MISC_FEATURE (7)..(11): Lactam bridge connecting residues 7 and 11

SEQ ID NO: 1230 - protein, 34 aa, Artificial Sequence
  Synthetic Polypeptide
  MISC_FEATURE (1)..(34): Glucagon analogue
  MISC_FEATURE (11)..(15): Lactam bridge connecting residues 11 and 15
FTSEYSKYLDERRAKDFVQWLMNTGPSSGAPPPS

SEQ ID NO: 1231 - protein, 34 aa, Artificial Sequence
  Synthetic Polypeptide
  MISC_FEATURE (1)..(34): Glucagon analogue
  MISC_FEATURE (7)..(11): Lactam bridge connecting residues 7 and 11
FTSDYSKYLDERRAQDFVQWLMNTGPSSGAPPPS

SEQ ID NO: 1232 - protein, 34 aa, Artificial Sequence; identical to SEQ ID NO: 1228
  Synthetic Polypeptide
  MISC_FEATURE (1)..(34): Glucagon analogue
  MOD_RES (1)..(1): N-terminal amino group replaced with hydroxy group
  MISC_FEATURE (7)..(11): Lactam bridge connecting residues 7 and 11

SEQ ID NO: 1233 - protein, 34 aa, Artificial Sequence; identical to SEQ ID NO: 1230
  Synthetic Polypeptide
  MISC_FEATURE (1)..(34): Glucagon analogue
  MOD_RES (1)..(1): N-terminal amino group replaced with hydroxy group
  MISC_FEATURE (11)..(15): Lactam bridge connecting residues 11 and 15

SEQ ID NO: 1234 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
FTSDYSKYLDSRRAQDFVQWLMDT

SEQ ID NO: 1235 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (7)..(11): Lactam bridge connecting residues 7 and 11
FTSEYSKYLDERRAQDFVQWLMNT

SEQ ID NO: 1236 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (11)..(15): Lactam bridge connecting residues 11 and 15
FTSEYSKYLDERRAKDFVQWLMNT

SEQ ID NO: 1237 - protein, 31 aa, Artificial Sequence
  Synthetic Polypeptide
  MISC_FEATURE (1)..(31): Glucagon analogue
HSQGTFTSDYARYLDARRAREFIKWLVRGRG

SEQ ID NO: 1238 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1239 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MOD_RES (24)..(24): C-terminal alpha carboxylate replaced with amide
FTSXYSKYLXERRAKDFVQWLXNT

SEQ ID NO: 1240 - protein, 29 aa, Artificial Sequence
  Synthetic Polypeptide
  MISC_FEATURE (1)..(29): Glucagon analogue
HSQGTFTSDYSKYLDSCRAQDFVQWLMNT

SEQ ID NO: 1241 - protein, 39 aa, Artificial Sequence; identical to SEQ ID NO: 436
  Synthetic Polypeptide
  MISC_FEATURE (1)..(39): Glucagon Analogue

SEQ ID NO: 1242 - protein, 29 aa, Artificial Sequence
  Synthetic Polypeptide
  MISC_FEATURE (1)..(29): Glucagon analogue
  MOD_RES (24)..(24): 2-butyrolactone bound through thiol group of Cysteine
HSQGTFTSDYSKYLDSRRAQCFVQWLMNT

SEQ ID NO: 1243 - protein, 29 aa, Artificial Sequence
  Synthetic Polypeptide
  MISC_FEATURE (1)..(29): Glucagon Analogue
  MOD_RES (21)..(21): Carboxymethyl group bound through thiol group of Cysteine
HSQGTFTSDYSKYLDSRRAQCFVQWLMNT

SEQ ID NO: 1244 - protein, 39 aa, Homo sapiens
HSQGTFTSDYSRYLDSRRAQDFVQWLRNTGPSSGAPPPS

SEQ ID NO: 1245 - protein, 35 aa, Artificial Sequence; identical to SEQ ID NO: 1146
  Synthetic Polypeptide
  MISC_FEATURE (1)..(35): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (7)..(11): Lactam bridge connecting residues 7 and 11
  MISC_FEATURE (10)..(10): Xaa is Asp, Glu, cysteic acid, homoglutamic acid or homocysteic acid
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (25)..(25): Xaa is Cys, Orn, homocysteine or acetyl phenyalanine
  MOD_RES (25)..(25): Pegylated

SEQ ID NO: 1246 - protein, 35 aa, Artificial Sequence; identical to SEQ ID NO: 1147
  Synthetic Polypeptide
  MISC_FEATURE (1)..(35): Glucagon analogue
  MOD_RES (1)..(1): N-terminal amino group replaced with hydroxy group
  MISC_FEATURE (4)..(4): Xaa is aspartic acid, glutamic acid, cysteic acid or homocysteic acid
  MISC_FEATURE (10)..(10): Xaa is Asp, Glu, cysteic acid, homoglutamic acid or homocysteic acid
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Lys, Asp, Glu, cysteic acid and homocysteic acid
  MISC_FEATURE (24)..(24): Xaa is Thr, Asp, Glu, cysteic acid and homocysteic acid
  MISC_FEATURE (35)..(35): Xaa is Cys, Orn, homocysteine or acetyl phenyalanine
  MOD_RES (35)..(35): Pegylated

SEQ ID NO: 1247 - protein, 24 aa, Artificial Sequence
  Synthetic Polypeptide
  MISC_FEATURE (1)..(24): Glucagon analogue
  MISC_FEATURE (4)..(4): Xaa is glutamic acid, homoglutamic acid, cysteic acid or homocysteic acid
  MISC_FEATURE (7)..(11): Lactam bridge connecting residues 7 and 11
  MISC_FEATURE (10)..(10): Xaa is Glu or Asp
  MISC_FEATURE (22)..(22): Xaa is Met, Leu or Nle
  MISC_FEATURE (23)..(23): Xaa is Asn, Asp or Glu
FTSXYSKYLXERRAQDFVQWLXXT

SEQ ID NO: 1248 - protein, 24 aa, Artificial Sequence
  Synthetic Polypeptide
  MISC_FEATURE (1)..(24): Glucagon analogue
  MISC_FEATURE (4)..(4): Xaa is glutamic acid, homoglutamic acid,  cysteic acid or homocysteic acid
  MISC_FEATURE (10)..(10): Xaa is Asp or Glu
  MISC_FEATURE (11)..(15): Lactam bridge connecting residues 11 and 15
  MISC_FEATURE (22)..(22): Xaa is Met, Leu or Nle
  MISC_FEATURE (23)..(23): Xaa is Asn, Asp or Glu
FTSXYSKYLXERRAKDFVQWLXXT

SEQ ID NO: 1249 - protein, 23 aa, Artificial Sequence
  Synthetic Polypeptide
  MISC_FEATURE (1)..(23): Glucagon analogue
TSDYSKYLDERRAKDFVQWLMDT

SEQ ID NO: 1250 - protein, 11 aa, Artificial Sequence
  Synthetic Polypeptide
  MISC_FEATURE (1)..(11): Peptide fragment representing the carboxy terminal 10 amino acids of Exendin-4 plus one additional amino acid
  MISC_FEATURE (11)..(11): Xaa is selected form the group consisting of Cys, Orn, Lys, homocysteine and acetyl phenyalanine
GPSSGAPPPSX

SEQ ID NO: 1251 - protein, 24 aa, Artificial Sequence
  Synthetic Polypeptide
  MISC_FEATURE (1)..(24): Glucagon analogue
  MOD_RES (1)..(1): N-terminal amino group replaced with hydroxy group
  MISC_FEATURE (4)..(4): Xaa is aspartic acid, glutamic acid, cysteic acid, homoglutamic acid or homocysteic acid
  MISC_FEATURE (7)..(7): Xaa is Lys or Glu
  MISC_FEATURE (10)..(10): Xaa is Asp, Glu, cysteic acid, homoglutamic acid or homocysteic acid
  MISC_FEATURE (11)..(11): Xaa is Ala, Ser, Glu, Lys Gln, homoglutamic acid or homocysteic acid
  MISC_FEATURE (15)..(15): Xaa is Arg, Gln, Glu or Lys
  MISC_FEATURE (19)..(19): Xaa is Ala, Gln, Lys or Glu
  MISC_FEATURE (22)..(22): Xaa is Met, Leu or Nle
  MISC_FEATURE (23)..(23): Xaa is Asn, Lys or an acidic amino acid
  MISC_FEATURE (24)..(24): Xaa is Thr, Gly or an acidic amino acid
FTSXYSXYLXXRRAXDFVXWLXXX

SEQ ID NO: 1252 - protein, 6 aa, Artificial Sequence
  Synthetic Polypeptide
  MISC_FEATURE (6)..(6): Xaa is phenyl lactic acid
HSQGTX

SEQ ID NO: 1253 - protein, 5 aa, Artificial Sequence
  Synthetic Polypeptide
  MISC_FEATURE (5)..(5): Xaa is phenyl lactic acid
SQGTX

SEQ ID NO: 1254 - protein, 4 aa, Artificial Sequence
  Synthetic Polypeptide
  MISC_FEATURE (4)..(4): Xaa is phenyl lactic acid
QGTX

SEQ ID NO: 1255 - protein, 3 aa, Artificial Sequence
  Synthetic Polypeptide
  MISC_FEATURE (3)..(3): Xaa is phenyl lactic acid
GTX

SEQ ID NO: 1256 - protein, 2 aa, Artificial Sequence
  Synthetic Polypeptide
  MISC_FEATURE (2)..(2): Xaa is phenyl lactic acid
TX

SEQ ID NO: 1257 - protein, 6 aa, Artificial Sequence
  Synthetic Polypeptide
  MISC_FEATURE (1)..(1): Xaa is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, Val, Gly, N-methyl serine, N-methyl alanine, and aminoisobutyric acid (AIB)
  MISC_FEATURE (3)..(3): Xaa is selected from a group consisting of Glu or Gln
  MISC_FEATURE (6)..(6): Xaa is phenyl lactic acid
XXXGTX

SEQ ID NO: 1258 - protein, 5 aa, Artificial Sequence
  Synthetic Polypeptide
  MISC_FEATURE (1)..(1): Xaa is selected from a group consisting of Ser, D-serine, D-alanine, Val, Gly, N-methyl serine, N-methyl alanine, and aminoisobutyric acid (AIB)
  MISC_FEATURE (2)..(2): Xaa is selected from a group consisting of Glu or Gln
  MISC_FEATURE (5)..(5): Xaa is phenyl lactic acid
XXGTX

SEQ ID NO: 1259 - protein, 4 aa, Artificial Sequence
  Synthetic Polypeptide
  MISC_FEATURE (1)..(1): Xaa is selected from a group consisting of Glu or Gln
  MISC_FEATURE (4)..(4): Xaa is phenyl lactic acid
XGTX

SEQ ID NO: 1260 - protein, 24 aa, Artificial Sequence
  Synthetic Polypeptide
  MISC_FEATURE (1)..(24): Peptide A
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1261 - protein, 24 aa, Artificial Sequence
  Synthetic Polypeptide
  MISC_FEATURE (1)..(24): Peptide B
  MOD_RES (1)..(1): N-terminal amino group replaced with hydroxy group
  MOD_RES (24)..(24): C-terminal alpha carboxylate replaced with amide
FTSEYSKYLDSRRAQDFVQWLMNT

SEQ ID NO: 1262 - protein, 24 aa, Artificial Sequence
  Synthetic Polypeptide
  MISC_FEATURE (1)..(24): Peptide C
  MOD_RES (1)..(1): N-terminal amino group replaced with hydroxy group
  MISC_FEATURE (4)..(7): Lactam bridge connecting residues 4 and 7
  MOD_RES (24)..(24): C-terminal alpha carboxylate replaced with amide
FTSEYSKYLDSRRAQDFVQWLMNT

SEQ ID NO: 1263 - protein, 28 aa, Artificial Sequence
  Synthetic Polypeptide
  MISC_FEATURE (1)..(28): Peptide D
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1264 - protein, 28 aa, Artificial Sequence
  Synthetic Polypeptide
  MISC_FEATURE (1)..(28): Peptide E
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
AEGTXTSDYSKYLDERRAKDFVQWLMDT

SEQ ID NO: 1265 - protein, 28 aa, Artificial Sequence
  Synthetic Polypeptide
  MISC_FEATURE (1)..(28): Peptide F
  MISC_FEATURE (15)..(19): Lactam bridge connecting residues 15 and 19
  MOD_RES (28)..(28): C-terminal alpha carboxylate replaced with amide
SQGTFTSEYSKYLDERRAKDFVQWLMDT

SEQ ID NO: 1266 - protein, 28 aa, Artificial Sequence
  Synthetic Polypeptide
  MISC_FEATURE (1)..(28): Peptide G
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
SQGTXTSDYSKYLDERRAKDFVQWLMDT

SEQ ID NO: 1267 - protein, 24 aa, Artificial Sequence
  Synthetic Polypeptide
  MISC_FEATURE (1)..(24): Peptide H
  MOD_RES (1)..(1): N-terminal amino group replaced with hydroxy group
  MISC_FEATURE (5)..(5): Covalently linked to a cholesterol acid moiety
  MISC_FEATURE (11)..(15): Lactam bridge connecting residues 11 to 15
  MOD_RES (24)..(24): C-terminal alpha carboxylate replaced with amide
FTSDKSKYLDERRAKDFVQWLMDT

SEQ ID NO: 1268 - protein, 25 aa, Artificial Sequence
  Synthetic Polypeptide
  MISC_FEATURE (1)..(25): Peptide I
  MOD_RES (1)..(1): N-terminal amino group replaced with hydroxy group
  MISC_FEATURE (11)..(15): Lactam bridge connecting residues 11 and 15
  MISC_FEATURE (25)..(25): Covalently linked to a cholesterol acid moiety
  MOD_RES (25)..(25): C-terminal alpha carboxylate replaced with amide
FTSDYSKYLDERRAKDFVQWLMDTK

SEQ ID NO: 1269 - protein, 35 aa, Artificial Sequence
  Synthetic Polypeptide
  MISC_FEATURE (1)..(35): Peptide J
  MOD_RES (1)..(1): N-terminal amino group replaced with hydroxy group
  MISC_FEATURE (11)..(15): Lactam bridge connecting residues 11 and 15
  MISC_FEATURE (35)..(35): Covalently linked to a cholesterol acid moiety
  MOD_RES (35)..(35): C-terminal alpha carboxylate replaced with amide
FTSDYSKYLDERRAKDFVQWLMDTGPSSGAPPPSK

SEQ ID NO: 1270 - protein, 28 aa, Artificial Sequence
  Synthetic Polypeptide
  MISC_FEATURE (1)..(28): Peptide K
  MISC_FEATURE (1)..(1): Xaa is amino isobutyric acid
  MISC_FEATURE (4)..(5): Threonine in position 4 and phenyl lactic acid in position 5 are linked via ester bond
  MISC_FEATURE (5)..(5): Xaa is phenyl lactic acid
  MISC_FEATURE (15)..(19): Lactam bridge connecting residues 15 and 19
  MOD_RES (28)..(28): C-terminal alpha carboxylate replaced with amide
XEGTXTSDYSKYLDERRAKDFVQWLMDT

SEQ ID NO: 1271 - protein, 34 aa, Artificial Sequence; identical to SEQ ID NO: 1228
  Synthetic Polypeptide
  MISC_FEATURE (1)..(34): Peptide L
  MOD_RES (34)..(34): C-terminal alpha carboxylate replaced with amide

SEQ ID NO: 1272 - protein, 34 aa, Artificial Sequence; identical to SEQ ID NO: 1228
  Synthetic Polypeptide
  MISC_FEATURE (1)..(34): Peptide M
  MOD_RES (1)..(1): N-terminal amino group replaced with hydroxy group
  MOD_RES (34)..(34): C-terminal alpha carboxylate replaced with amide

SEQ ID NO: 1273 - protein, 34 aa, Artificial Sequence; identical to SEQ ID NO: 1230
  Synthetic Polypeptide
  MISC_FEATURE (1)..(34): Peptide N
  MISC_FEATURE (11)..(15): Lactam bridge connecting residues 11 and 15
  MOD_RES (34)..(34): C-terminal alpha carboxylate replaced with amide

SEQ ID NO: 1274 - protein, 34 aa, Artificial Sequence; identical to SEQ ID NO: 1230
  Synthetic Polypeptide
  MISC_FEATURE (1)..(34): Peptide O
  MOD_RES (1)..(1): N-terminal amino group replaced with hydroxy group
  MISC_FEATURE (11)..(15): Lactam bridge connecting residues 11 and 15
  MOD_RES (34)..(34): C-terminal alpha carboxylate replaced with amide

SEQ ID NO: 1275 - protein, 24 aa, Artificial Sequence
  Synthetic Polypeptide
  MISC_FEATURE (1)..(24): Peptide P
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYIDERRAQDFVQWLMDT

SEQ ID NO: 1276 - protein, 24 aa, Artificial Sequence
  Synthetic Polypeptide
  MISC_FEATURE (1)..(24): Peptide Q
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKDFVQWLMDT

SEQ ID NO: 1277 - protein, 24 aa, Artificial Sequence
  Synthetic Polypeptide
  MISC_FEATURE (1)..(24): Peptide R
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAKDFVEWLMDT

SEQ ID NO: 1278 - protein, 24 aa, Artificial Sequence
  Synthetic Polypeptide
  MISC_FEATURE (1)..(24): Peptide S
  MOD_RES (1)..(1): N-terminal amino group replaced with hydroxy group
  MISC_FEATURE (19)..(23): Lactam bridge connecting residues 19 and 23
  MOD_RES (24)..(24): C-terminal alpha carboxylate replaced with amide
FTSDYSKYLDERRAQDFVEWLMKT

SEQ ID NO: 1279 - protein, 24 aa, Artificial Sequence
  Synthetic Polypeptide
  MISC_FEATURE (1)..(24): Peptide T
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDEQAAKDFIAWLMDT

SEQ ID NO: 1280 - protein, 24 aa, Artificial Sequence
  Synthetic Polypeptide
  MISC_FEATURE (1)..(24): Peptide U
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDEQAAKEFIAWLMDT

SEQ ID NO: 1281 - protein, 28 aa, Artificial Sequence
  Synthetic Polypeptide
  MISC_FEATURE (1)..(28): Peptide V
  MISC_FEATURE (15)..(19): Lactam bridge connecting residues 15 and 19
  MOD_RES (28)..(28): C-terminal alpha carboxylate replaced with amide
AEGTFTSEYSKYLDERRAKDFVQWLMDT

SEQ ID NO: 1282 - protein, 28 aa, Artificial Sequence
  Synthetic Polypeptide
  MISC_FEATURE (1)..(28): Peptide W
  MISC_FEATURE (15)..(19): Lactam bridge connecting residues 15 and 19
  MOD_RES (28)..(28): C-terminal alpha carboxylate replaced with amide
AEGTFTSEYSKYLDEQAAKEFIAWLMDT

SEQ ID NO: 1283 - protein, 29 aa, Artificial Sequence
  Synthetic Polypeptide
  MISC_FEATURE (1)..(29): Peptide X
  MISC_FEATURE (16)..(20): Lactam bridge connection residues 16 and 20
  MOD_RES (29)..(29): C-terminal alpha carboxylate replaced with amide
HAEGTFTSEYSKYLDERRAKDFVQWLMDT

SEQ ID NO: 1284 - protein, 29 aa, Artificial Sequence
  Synthetic Polypeptide
  MISC_FEATURE (1)..(29): Peptide Y
  MISC_FEATURE (16)..(20): Lactam bridge connecting bridges 16 and 20
  MOD_RES (29)..(29): C-terminal alpha carboxylate replaced with amide
HAEGTFTSEYSKYLDEQAAKEFIAWLMDT

SEQ ID NO: 1285 - protein, 26 aa, Artificial Sequence
  Synthetic Polypeptide
  MISC_FEATURE (1)..(26): Peptide Z
  MISC_FEATURE (13)..(17): Lactam bridge connecting residues 13 and 17
  MOD_RES (26)..(26): C-terminal alpha carboxylate replaced with amide
GTFTSEYSKYLDERRAKDFVQWLMDT

SEQ ID NO: 1286 - protein, 28 aa, Artificial Sequence
  Synthetic Polypeptide
  MISC_FEATURE (1)..(28): Peptide AA
  MISC_FEATURE (5)..(6): Threonine in position 5 and phenyl lactic acid in position 6 linked via ester bond
  MISC_FEATURE (15)..(19): Lactam bridge connecting residues 15 and 19
  MOD_RES (28)..(28): C-terminal alpha carboxylate replaced with amide
SQGTFTSEYSKYIDERRAKDFVQWLMDT

SEQ ID NO: 1287 - protein, 29 aa, Artificial Sequence
  Synthetic Polypeptide
  MISC_FEATURE (1)..(29): Peptide AB
  MISC_FEATURE (5)..(6): Threonine at position 5 and phenyl lactic acid at position 6 linked via ester bond
  MISC_FEATURE (6)..(6): Xaa is phenyl lactic acid
  MISC_FEATURE (16)..(20): Lactam bridge connecting residues 16 and 20
  MOD_RES (29)..(29): C-terminal alpha carboxylate replaced with amide
HAEGTXTSDYSKYLDERRAKDFVQWLMDT

SEQ ID NO: 1288 - protein, 24 aa, Artificial Sequence
  Synthetic Polypeptide
  MISC_FEATURE (1)..(24): Peptide AC
  MOD_RES (1)..(1): N-terminal amino group replaced with hydroxy group
  MISC_FEATURE (7)..(11): Lactam bridge connecting residues 7 and 11
  MOD_RES (19)..(19): Pegylated
  MOD_RES (24)..(24): C-terminal alpha carboxylate replaced with amide
FTSDYSKYLDERRAQDFVCWLMDT

SEQ ID NO: 1289 - protein, 35 aa, Artificial Sequence
  Synthetic Polypeptide
  MISC_FEATURE (1)..(35): Peptide AD
  MOD_RES (1)..(1): N-terminal amino group replaced with hydroxy group
  MISC_FEATURE (7)..(11): Lactam bridge connecting residues 7 and 11
  MOD_RES (35)..(35): Pegylated
  MOD_RES (35)..(35): C-terminal alpha carboxylate replaced with amide
FTSDYSKYLDERRAQDFVQWLMDTGPSSGAPPPSC

SEQ ID NO: 1290 - protein, 24 aa, Artificial Sequence
  Synthetic Polypeptide
  MISC_FEATURE (1)..(24): Peptide AE
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSDYSKYLDERRAKDFVCWLMDT

SEQ ID NO: 1291 - protein, 35 aa, Artificial Sequence
  Synthetic Polypeptide
  MISC_FEATURE (1)..(35): Peptide AF
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPSSGAPPPSC

SEQ ID NO: 1292 - protein, 24 aa, Artificial Sequence
  Synthetic Polypeptide
  MISC_FEATURE (1)..(24): Peptide AG
  MOD_RES (1)..(1): N-terminal amino group replaced with hydroxy group
  MOD_RES (1)..(1): Covalently attached to a C16 fatty acid
  MISC_FEATURE (11)..(15): Lactam bridge connection residues 11 and 15
  MOD_RES (24)..(24): C-terminal alpha carboxylate replaced with amide
FTSDYSKYLDERRAKDFVQWLMDT

SEQ ID NO: 1293 - protein, 24 aa, Artificial Sequence
  Synthetic Polypeptide
  MISC_FEATURE (1)..(24): Peptide AH
  MOD_RES (1)..(1): N-terminal amino group replaced with hydroxy group
  MOD_RES (5)..(5): Linked to a C16 fatty acid via Glu residue
  MISC_FEATURE (11)..(15): Lactam bridge connecting residues 11 and 15
  MISC_FEATURE (15)..(15): Linked to a C16 fatty acid via Glu residue
  MOD_RES (24)..(24): C-terminal alpha carboxylate replaced with amide
FTSDKSKYLDERRAKDFVQWLMDT

SEQ ID NO: 1294 - protein, 24 aa, Artificial Sequence
  Synthetic Polypeptide
  MISC_FEATURE (1)..(24): Peptide AI
  MOD_RES (1)..(1): N-terminal amino group replaced with hydroxy group
  MISC_FEATURE (15)..(15): Linked to C16 fatty acid via Glu residue
  MOD_RES (24)..(24): C-terminal alpha carboxylate replaced with amide
FTSDYSKYLDERRAKDFVQWLMDT

SEQ ID NO: 1295 - protein, 24 aa, Artificial Sequence
  Synthetic Polypeptide
  MISC_FEATURE (1)..(24): Peptide AJ
  MOD_RES (1)..(1): N-terminal amino group replaced with hydroxy group
  MISC_FEATURE (11)..(15): Lactam bridge connecting residues 11 and 15
  MISC_FEATURE (19)..(19): Linked to a C16 fatty acid via Glu residue
  MOD_RES (24)..(24): C-terminal alpha carboxylate replaced with amide
FTSDYSKYLDERRAKDFVKWLMDT

SEQ ID NO: 1296 - protein, 24 aa, Artificial Sequence
  Synthetic Polypeptide
  MISC_FEATURE (1)..(24): Peptide AK
  MOD_RES (1)..(1): N-terminal amino group replaced with hydroxy group
  MISC_FEATURE (11)..(15): Lactam bridge connecting residues 11 and 15
  MISC_FEATURE (24)..(24): Linked to a C16 fatty acid via Glu residue
  MOD_RES (24)..(24): C-terminal alpha carboxylate replaced with amide
FTSDYSKYLDERRAKDFVQWLMDK

SEQ ID NO: 1297 - protein, 24 aa, Artificial Sequence
  Synthetic Polypeptide
  MISC_FEATURE (1)..(24): Peptide AP
  MOD_RES (1)..(1): N-terminal amino group replaced with hydroxy group
  MISC_FEATURE (11)..(11): Xaa is amino isobutyric acid
  MOD_RES (24)..(24): C-terminal alpha carboxylate replaced with amide
FTSDYSKYLDXRRAQDFVQWLMNT

SEQ ID NO: 1298 - protein, 24 aa, Artificial Sequence
  Synthetic Polypeptide
  MISC_FEATURE (1)..(24): Peptide AR
  MOD_RES (1)..(1): N-terminal amino group replaced with hydroxy group
  MISC_FEATURE (11)..(11)
  MISC_FEATURE (15)..(15): Xaa is alpha isobutyric acid
  MOD_RES (24)..(24): C-terminal alpha carboxylate replaced with amide
FTSDKSKYLDXRRAXDFVCWLMNT

SEQ ID NO: 1299 - protein, 24 aa, Artificial Sequence
  Synthetic Polypeptide
  MISC_FEATURE (1)..(24): Peptide AS
  MOD_RES (1)..(1): N-terminal amino group replaced with hydroxy group
  MOD_RES (24)..(24): C-terminal alpha carboxylate replaced with amide
FTSDYSKYLDERRAQDFVQWLMNT

SEQ ID NO: 1300 - protein, 24 aa, Artificial Sequence
  Synthetic Polypeptide
  MISC_FEATURE (1)..(24): Peptide AU
  MOD_RES (1)..(1): N-terminal amino group replaced with hydroxy group
  MOD_RES (24)..(24): C-terminal alpha carboxylate replaced with amide
FTSDKSKYLDERRAQDFVCWLMNT

SEQ ID NO: 1301 - protein, 24 aa, Artificial Sequence
  Synthetic Polypeptide
  MISC_FEATURE (1)..(24): Peptide AV
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1302 - protein, 24 aa, Artificial Sequence
  Synthetic Polypeptide
  MISC_FEATURE (1)..(24): Peptide AW
  MISC_FEATURE (4)..(7): Lactam bridge connecting residues 4 and 7
  MOD_RES (11)..(11): Xaa is alpha isobutyric acid
  MOD_RES (24)..(24): C-terminal carboxylate replaced with amide
FTSEYSKYLDXRRAQDFVQWLMNT

SEQ ID NO: 1303 - protein, 24 aa, Artificial Sequence
  Synthetic Polypeptide
  MISC_FEATURE (1)..(24): Peptide AX
  MOD_RES (1)..(1): N-terminal amino group replaced with hydroxy group
  MISC_FEATURE (11)..(15): Lactam bridge connecting residues 11 and 15
  MOD_RES (24)..(24): C-terminal alpha carboxylate replaced with amide
FTSDYSKYLDERRAKEFVQWLMDT

SEQ ID NO: 1304 - protein, 24 aa, Artificial Sequence
  Synthetic Polypeptide
  MISC_FEATURE (1)..(24): Peptide AY
  MOD_RES (1)..(1): N-terminal amino group replaced with hydroxy group
  MOD_RES (24)..(24): C-terminal alpha carboxylate replaced with amide
FTSDYSKYLDEQAAKEFIAWLMNT

SEQ ID NO: 1305 - protein, 34 aa, Artificial Sequence; identical to SEQ ID NO: 1230
  Synthetic Polypeptide
  MISC_FEATURE (1)..(34): Peptide AZ
  MOD_RES (34)..(34): C-terminal alpha carboxylate replaced with amide

SEQ ID NO: 1306 - protein, 24 aa, Artificial Sequence
  Synthetic Polypeptide
  MISC_FEATURE (1)..(24): Peptide BA
  MOD_RES (1)..(1): N-terminal amino group replaced with hydroxy group
  MISC_FEATURE (5)..(5): Linked to a C16 fatty acid via Glu residue
  MISC_FEATURE (7)..(7): Linked to a C16 fatty acid via Glu residue
  MOD_RES (24)..(24): C-terminal carboxylate replaced with amide
FTSDKSKYLDERRAKDFVQWLMDT

SEQ ID NO: 1307 - protein, 6 aa, Artificial Sequence
  Synthetic Polypeptide
  MISC_FEATURE (1)..(1): Xaa1 is selected from a group consisting of His, D-histidine, alpha, alpha-dimethyl imidiazole acetic acid (DMIA), N-methyl histidine, alpha-methyl histidine, imidazole acetic acid, desaminohistidine, hydroxyl-histidine, acetyl-histidine and
  MISC_FEATURE (2)..(2): Xaa is selected from a group consisting of Ser, D-serine, D-alanine, valine, glycine, N-methyl serine, and aminoisobutyric acid (AIB)
  MISC_FEATURE (3)..(3): Xaa is selected from a group consisting of Glu or Gln
XXXTGF

SEQ ID NO: 1308 - protein, 5 aa, Artificial Sequence
  Synthetic Polypeptide
  MISC_FEATURE (1)..(1): Xaa is selected from a group consisting of Ser, D-serine, D-alanine, valine, glycine, N-methyl serine, and aminoisobutyric acid (AIB)
  MISC_FEATURE (2)..(2): Xaa is selected from a group consisting of Glu or Gln
XXTGF

SEQ ID NO: 1309 - protein, 4 aa, Artificial Sequence
  Synthetic Polypeptide
  MISC_FEATURE (1)..(1): Xaa is selected from a group consisting of Glu or Gln
XTGF

SEQ ID NO: 1310 - protein, 24 aa, Artificial Sequence
  Synthetic Polypeptide
  MISC_FEATURE (1)..(24): Peptide AL
  MOD_RES (1)..(1): N-terminal amino group replaced with hydroxy group
  MOD_RES (24)..(24): C-terminal alpha carboxylate replaced with amide
FTSDYSKYLDSRRAQDFVQWLMDT

SEQ ID NO: 1311 - protein, 28 aa, Artificial Sequence
  Synthetic Polypeptide
  MISC_FEATURE (1)..(28): Peptide AM
  MOD_RES (28)..(28): C-terminal alpha carboxylate replaced with amide
SQGTFTSEYSKYLDSRRAQDFVQWLMNT

SEQ ID NO: 1312 - protein, 28 aa, Artificial Sequence
  Synthetic Polypeptide
  MISC_FEATURE (1)..(28): Peptide AN
  MISC_FEATURE (4)..(5): Threonine at position 4 and phenyl lactic acid at position 5 linked via ester bond
  MISC_FEATURE (5)..(5): Xaa is phenyl lactic acid
  MOD_RES (28)..(28): C-terminal alpha carboxylate replaced with amide
SQGTXTSEYSKYLDSRRAQDFVQWLMNT

SEQ ID NO: 1313 - protein, 29 aa, Artificial Sequence
  Synthetic Polypeptide
  MISC_FEATURE (1)..(29): Peptide AO
  MISC_FEATURE (5)..(6): Threorine at position 5 and phenyl lactic acid at position 6 linked via ester bond
  MISC_FEATURE (6)..(6): Xaa is phenyl lactic acid
  MOD_RES (29)..(29): C-terminal alpha carboxylate replaced with amide
HSQGTXTSEYSKYLDSRRAQDFVQWLMNT

SEQ ID NO: 1314 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated
  MOD_RES (24)..(24): C-terminal alpha carboxylate replaced with amide
FTSEYSKYLDERRAKDFVCWLMNT

SEQ ID NO: 1315 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MISC_FEATURE (19)..(19): Pegylated via spacer
  MOD_RES (24)..(24): C-terminal alpha carboxylate replaced with amide
FTSDYSKYLDERRAKDFVKWLMDT

SEQ ID NO: 1316 - protein, 24 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (19)..(19): Pegylated via rigid spacer
  MOD_RES (24)..(24): C-terminal alpha carboxylate replaced with amide
FTSDYSKYLDERRAKDFVKWLMDT

SEQ ID NO: 1317 - protein, 35 aa, Artificial Sequence
  Synthetic Polypeptide
  MISC_FEATURE (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDTGPGPGPGPGPC

SEQ ID NO: 1318 - protein, 35 aa, Artificial Sequence
  Synthetic Polypeptide
  MOD_RES (1)..(1): N-terminal amino group replaced with hydroxy group
  MISC_FEATURE (11)..(15): Lactam bridge connecting residues 11 and 15
  MOD_RES (35)..(35): Pegylated
  MOD_RES (35)..(35): C-terminal alpha carboxylate replaced with amide
FTSDYSKYLDERRAKDFVQWLMDGGPSSGAPPPSC

SEQ ID NO: 1319 - protein, 29 aa, Artificial Sequence
  Synthetic Polypeptide
  MISC_FEATURE (1)..(29): Peptide X
  MISC_FEATURE (16)..(20): Lactam bridge connection residues 16 and 20
  MOD_RES (29)..(29): C-terminal alpha carboxylate replaced with amide
HAEGTFTSEYSKYIDERRAKDFVQWLMDT

SEQ ID NO: 1320 - protein, 11 aa, Artificial Sequence
  Synthetic peptide
GPSSGAPPPSA

SEQ ID NO: 1321 - protein, 24 aa, Artificial Sequence
  Synthetic Polypeptide
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAEDFVKWLMDT

SEQ ID NO: 1322 - protein, 24 aa, Artificial Sequence
  Synthetic Polypeptide
  MOD_RES (1)..(1): N-terminal amino group replaced with hydroxy group
  MISC_FEATURE (15)..(19): Lactam bridge connecting residues 15 and 19
  MOD_RES (24)..(24): C-terminal alpha carboxylate replaced with amide
FTSDYSKYLDERRAQDFVEWLMKT

SEQ ID NO: 1323 - protein, 31 aa, Artificial Sequence; identical to SEQ ID NO: 1237
  Synthetic Polypeptide

SEQ ID NO: 1324 - protein, 34 aa, Artificial Sequence
  Synthetic Polypeptide
FTSEYSKYIDERRAQDFVQWIMNTGPSSGAPPPS

SEQ ID NO: 1325 - protein, 34 aa, Artificial Sequence; identical to SEQ ID NO: 1324
  Synthetic Polypeptide
  MISC_FEATURE (11)..(15): Lactam bridge connecting residues 11 and 15

SEQ ID NO: 1326 - protein, 34 aa, Artificial Sequence
  Synthetic Polypeptide
  MISC_FEATURE (16)..(20): Lactam bridge connecting residues 16 and 20
FTSEYSKYIDERRAKDFVQWIMNTGPSSGAPPPS

SEQ ID NO: 1327 - protein, 34 aa, Artificial Sequence
  Synthetic Polypeptide
  MISC_FEATURE (6)..(11): Lactam bridge connecting residues 6 and 11
FTSDYSKYIDERRAQDFVQWIMNTGPSSGAPPPS

SEQ ID NO: 1328 - protein, 34 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSEYSKYIDERRAQDFVQWLMNTGPSSGAPPPS

SEQ ID NO: 1329 - protein, 34 aa, Artificial Sequence; identical to SEQ ID NO: 1230
  Synthetic Polypeptide
  MISC_FEATURE (1)..(1): N-terminal amino group replaced with hydroxy group
  MISC_FEATURE (11)..(15): Lactam bridge connecting residues 11 and 15

SEQ ID NO: 1330 - protein, 24 aa, Artificial Sequence
  Synthetic Polypeptide
  MISC_FEATURE (1)..(1): N-terminal amino group replaced with hydroxy group
FTSDYSKYLDSRRAQDFVQWLMDT

SEQ ID NO: 1331 - protein, 24 aa, Artificial Sequence
  Synthetic Polypeptide
  MOD_RES (1)..(1): N-terminal amino group replaced with hydroxy group
  MISC_FEATURE (7)..(11): Lactam bridge connecting residues 7 and 11
  MOD_RES (24)..(24): C-terminal alpha carboxylate replaced with amide
FTSDYSKYLDERRAQDFVQWLMDT

SEQ ID NO: 1332 - protein, 24 aa, Artificial Sequence
  Synthetic Polypeptide
  MISC_FEATURE (1)..(1): N-terminal amino group replaced with hydroxy group
  MISC_FEATURE (11)..(15): Lactam bridge connecting residues 11 and 15
FTSDYSKYLDERRAKDFVQWLMDT

SEQ ID NO: 1333 - protein, 24 aa, Artificial Sequence
  Synthetic Polypeptide
  MOD_RES (1)..(1): N-terminal amino group replaced with hydroxy group
  MOD_RES (24)..(24): C-terminal alpha carboxylate replaced with amide
FTSDYSKYLDERRAKDFVQWLMDT

SEQ ID NO: 1334 - protein, 11 aa, Artificial Sequence
  Synthetic peptide
GPSSGAPPPSK

The invention claimed is:

1. A conjugate comprising (i) a Glucose-dependent Insulinotropic Peptide (GIP) agonist peptide and (ii) a glucagon antagonist peptide, wherein the GIP agonist peptide is an analog of native human glucagon (SEQ ID NO: 1) modified to comprise
Tyr at position 1;
AIB at position 2;
Glu or Gln at position 3;
Ile at position 12;
Lys or Glu at position 16
Gln at position 17;
Ala at position 18;
Lys or AIB at position 20;
Glu at position 21;
Asn at position 24;
Leu at position 27;
Ala at position 28;
Gly at position 29;
GPSSGAPPPS (SEQ ID NO: 3) at positions 30-39;
an acylated Lys or pegylated Cys at position 40; and a lactam bridge between the side chains of amino acids at positions i and i+4 wherein i is 12 or 16; and the glucagon antagonist peptide comprises the amino acid sequence of native glucagon (SEQ ID NO: 1) modified to comprise
(i) Ala at position 2;
Glu at position 3;
Glu at positions 9 and 16;
Ile at position 14; and
Gln or Lys at position 20; and
a lactam bridge between the side chains of amino acids at positions i and i+4 wherein i is 12 and 16; or
(ii) amino acids 6-29 of SEQ ID NO: 1, further modified to comprise phenyl lactic acid (PLA) or Phe at position 6;
Glu at positions 9 and 16;
a lactam bridge between the side chains of amino acids at positions i and i+4 wherein i is 12 or 16 and GPSSGAPPPS (SEQ ID NO: 3) at positions 30-39.

2. The conjugate of claim 1, wherein the GIP agonist peptide is covalently attached to the glucagon antagonist peptide via a linker.

3. The conjugate of claim 1, wherein the conjugate is a fusion peptide comprising the GIP agonist peptide and the glucagon antagonist peptide.

4. The conjugate of claim 1, wherein the conjugate is a heterodimer comprising the GIP agonist peptide linked to the glucagon antagonist peptide.

5. The conjugate of claim 4, wherein the heterodimer comprises a linker which connects the GIP agonist peptide linked to the glucagon antagonist peptide.

6. A pharmaceutical composition comprising a conjugate of claim 1, wherein the conjugate is in admixture with a pharmaceutically acceptable carrier.

7. The conjugate of claim 1 wherein
said Glucose-dependent Insulinotropic Peptide comprises an amino acid sequence selected from the group consisting of any of SEQ ID NOs: 175, 205, 335, 336,338, 359 and 360; and
said glucagon antagonist peptide comprises and amino acid sequence selected from the group consisting of 1229, 1232, 1319, 1325 and 1328.

8. A pharmaceutical composition comprising the peptide of claim 7 and a pharmaceutically acceptable carrier.

9. A conjugate comprising
(I) a GIP agonist peptide comprising native human glucagon (SEQ ID NO: 1) modified by:
(a) a substitution at position 1 with Tyr,
(b) a modification selected from the group consisting of:
(i) a lactam bridge between the side chains of amino acids at positions i and i+4, wherein i is 12, or 16, and
(ii) one, two, three, or all of the amino acids at positions 16, 20, 21, and 24 of the analog is substituted with amino isobutyric acid,
(c) 1-10 further amino acid modifications selected from the group consisting of:
(i) Ser at position 2 substituted with D-Ser, Ala, D-Ala, Gly, N-methyl-Ser, AIB, Val, or a-amino-N-butyric acid;
(ii) Linkage of an acyl group to a Lys at position 10;
(iii) Lys at position 12 substituted with Arg or Ile;
(iv) Ser at position 16 substituted with Glu, Gln, homoglutamic acid, homocysteic acid, Thr, Gly, or AIB;
(v) Arg at position 17 substituted with Gln;
(vi) Arg at position 18 substituted with Ala, Ser, Thr, or Gly;
(vii) Gln at position 20 substituted with Ser, Thr, Ala, Lys, Citrulline, Arg, Orn, or AIB;
(ix) the Met at position 27 substituted with Leu;
(x) the Asn at position 28 substituted with Ala;
(xi) the Thr at position 29 substituted with Gly; and
(xii) an extension of 1 to 21 amino acids C-terminal to the amino acid at position 29; and
(d) a C-terminal amide; and
(II) a glucagon antagonist peptide comprising a sequence selected from the group consisting of SEQ ID Nos: 1260-1270, 1273-1278, 1280-1288, 1290-1296, 1303, 1304, 1306, 1314-1318 and 1319, wherein the GIP agonist peptide is covalently attached to the glucagon antagonist peptide.

10. A conjugate comprising
(i) a GIP agonist peptide comprising the sequence of SEQ ID NO: 175; and
(ii) a glucagon antagonist peptide comprising the sequence of SEQ ID NO: 1319, wherein the GIP agonist peptide is covalently attached to the glucagon antagonist peptide.

* * * * *